United States Patent 7,745,391 (HUMAN THROMBOSPONDIN POLYPEPTIDE) - sequence listing, part 76

SEQ ID NO: 275800 - DNA, 5546 bp, Homo sapiens
ggatgaggagggggaaaccgggggaaaagagggaaaagagccgggagagaggtgggcaaggacgagggcgagggcacggccgggtcctggctggccaaacgaggctcgcggaagcagcagccgccgcctgaccgcagctggattttgaagattgatccaagggactgtattaatttcaggaattgatttgaaagacactggctctgccacttaacagccatgtaaccttggatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataagagtcaattgaggaaccatgagagagaacagcacagtcttccagataccttgtcaatagcaacttctaatgagccaagaatttccagtgatacagctgatggaaaatgtgtccaggaaggtatctatgtattttgttatgcaggctgcagtgacttgcacatgacataaaagtgcccttagttgtcatggttggttattttcagggcaaaagcctatattctcctccatttttgtaccatggatgtgagtgaatctgatctctgtttctgaggaaatgccaagtactgaatgaagcagatgattactaggtcctaggtgagaagccctagatagtaaggattcatcttcagttgaaacttaagagccccttagaaggtgatgtaccagcaagccagaaaagcaagccagaaaagctacaacatggaaaacaggcctcccctccctctctcggcaccagttgacctactgagaacagagcttttgcagatggtaggcccccaccccaaactttaactggggctccccgctgtgatcttattcttacccaagtatgactgccagatttcatctgcattattaaaaaaaaaaaagcacacacacagacacacaagatctttttatgtactagttaagtagcagtcaaccgagtttctggtaataagaatattagaatcaaaagatttaattagagctccatgaaaaggcggatgccacatccggagaattaaggataaagtgtactaagctgtgccgctttggttcagctcacttaaattgatatactttaaatgtctccagtgtggcacataatgtttatgggagataagacatattggggtgactttcccttttagatttgctaagaattaaagttagaaacgactacagagtgaaatgttttaccataatgtttcattaaattataccccagaaagcataactgattctagaatgcttctgaaagaactgattttgacaccactgtagcaccaaaattctcatgtcaaacagatgtcatccctgtaaaactctctgaaacaaaaggagtttatgatatagcatctgtttttgcagtagatggctgagctaaaacagttttgtttcctttttacaaaatagccctaaatgcctccttttattttaattcattatgtttccatatcccctttaaaggagacattaaaacgtctgatatgattggaccataaatccctaatgaaaggatgaagtaaatactactcagtagcaccacctgcagttaatatcagtgttggaagatgtcttttttagcacggtcctaaaaagcaaacatttcaaactgtccaaatgagttaacattaaaattcacaattttaataaaaagattaaagtgtcagctcaaaattaaaataaccacttcagactttacagtattaatgaatgtttactagattttatgttgcagcatcttttctttgtggctcatgctttttttttagggttacatgcatggatttttaaattgcctgccatgcctcttttcctccacctggctccatttgcttttttctctcagtactgtagcagttcaaatggctgcatacttatacctggatgggtactttattaactcaatattagatattttgaaatctggttgtcaggccaaagaaaaaatttttagctcacaaataaggtaataataattcatgctttgttaaaacttctttacctatttagtaaacttgttaaacaagaagagagatttgtgcctctgtgatcctcagtctctgccattcagatagcacagataccttagggcatgtttcagcttaacatttgcttggccaaaaggcatggcctgcctgtcttgagctagatactgtgttaggtgctgggagtacagtgaaaggcatcactgcccttcaggaatccaactcagtgaagaagacagaacgaggctgatgggtatgtcagcagataccgcaggagctcaaatagagccgcaagcaaagccctttcgtatggtgttactccatgaaacctaattaaattgttttttattggaaacctataatttgccaagcgctggggattcagtctaaacaaaacaagcagatccttatcctcagggaatagacagcttagtggcagggcagagattttacccagacatgcaggtaaagtacagactttgctaaaggaaaaatataggacttattaaactatgctgtgaggttctagcatttccaatttgtagatgagaaaactgagacttcaagaggcaaaataatttacccatgatcatactggtagaaagtggcagagcgaggactaagcccaagtttttgaactttaaatccaatattctttccattggaaacagttgcttgaagtagcacaggctctcattctgtgctatattaagtttttccatctgtcagttttattagttgtcattgatctgtaatatttctcacacaaaaccattatccaatatttcacacttcattttttagggtttttttaaaactgtatttggaacagtgccatttataatcaagtccaagtttttaacctaccaattaagagcaatacttagattataattatgattagtgtgtatattaacgttatagatttataccaggaaattaggacattttgttctgcttggcagtagttattagcaaaagaaaatttcaattttagaaaccgtaaatttaacttaaggattttctttgttgaaatttcagtgtgggttttcctttgtataataccacggattttacttttatgcggtgtatacaggtgttctacctaagctttcttcctgccaagagacacacagttcttcctgctctgcctttttcatgagcttccatgcttgctttgtttctgaatataaagcagagtgtgaatagcctgtggactgtatgctgacagacaagtacatgaagcgttgaatatcttcaagaaatcgttttatatgatcaagtcactcaactcgtgttgacataagcttaccccaacttgaattactcagccctgttgttgcagagtgagtttagtaacatggctacttttcgttggatccatgtctcctgcgtttcggagagctgcatattcatgtcagtcataacctttgtccctgtaacctgtcagttaactagaaagaattatacattgcatagcacttaaaaattt

SEQ ID NO: 275801 - DNA, 614 bp, Homo sapiens
gtttccagagctattttttcctaacttctgcaaaatcctcaagtcggcttgttagataaattatttaaatttgcattacgtaatagggttgcatgaacattcctctgaatttctttttacatggaatattgagaaatttttcactgccaaaaaaaaaatcattactttgtttcaccaagaaagagaaatgttttgatactatatactttcgttcttggccacagctggattttgaagattgatccaagggactgtattaatttcaggaattgatttgaaagacactggctctgccacttaacagccatgtaaccttgggtaagtcacttaaaccacactgagtgtttccttatttataagcctgtataacacccacctagcctgtcctaaagagttatgaggatcagataccactaacatgtttgatagagcctagctgtaaggagctgttactcttttcagtattgatattttgtacatttttattctcattgagaattaagatgaaaattggtgtattagagaaagcatggttttagagtgagattggcctggattcctgttcttaaaccagttaccactttgtgtctgtgagtctcaggtttctcatctgc

SEQ ID NO: 275802 - DNA, 2552 bp, Homo sapiens
ggatgaggagggggaaaccgggggaaaagagggaaaagagccgggagagaggtgggcaaggacgagggcgagggcacggccgggtcctggctggccaaacgaggctcgcggaagcagcagccgccgcctgaccgcagctggattttgaagattgatccaagggactgtattaatttcaggaattgatttgaaagacactggctctgccacttaacagccatgtaaccttggatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataagagtcaattgaggaaccatgagagagaacagcacagtcttccagataccttgtcaatagcaacttctaatgagccaagaatttccagtgatacacttacgtgaacggttcgggcaggtacaagtatttgtatgcagctgagtgatgaatgatagcccatgcagagtggactaaggagaaccacacatagccag

SEQ ID NO: 275803 - DNA, 2591 bp, Homo sapiens
ggatgaggagggggaaaccgggggaaaagagggaaaagagccgggagagaggtgggcaaggacgagggcgagggcacggccgggtcctggctggccaaacgaggctcgcggaagcagcagccgccgcctgaccgcagctggattttgaagattgatccaagggactgtattaatttcaggaattgatttgaaagacactggctctgccacttaacagccatgtaaccttggatatggaagaaagtagcagtgttgccatgttggtgccagatattggggaacaggaagctatactgactgctgaaagtatcatcagtccttcattggaaattgatgaacaaagaaaaactaaaccagatccattaatccatgttatccagaagttaagcaagatagtggaaaatgaaaagtcacaaaaatgtcttttaattgggaagaaacgcccacgttcaagtgctgcaacacactctcttgaaacccaagaactttgtgagattccggctaaagtaatccagtcacctgctgctgatactagaagggctgagatgtcacaaacaaattttacccctgacactcttgcccagaatgaagggaaggctatgtcttatcagtgtagcctttgtaagtttctatcatcatccttttccgtgttaaaagatcatattaagcaacatggtcagcaaaatgaagtgatactgatgtgctcagagtgccatattacatctagaagccaggaggaacttgaagcccacgtggtgaatgaccatgacaatgatgccaatatccacacccaatccaaagcccaacagtgcgtaagcccctccagctctttgtgtcggaaaaccacagaaagaaatgaaaccattccagatatcccagtaagtgtggacaatctacagactcatactgtccaaactgcatctgtggcagaaatgggtaggaggaaatggtatgcatacgaacagtacggcatgtatcgatgcttgttttgtagttatacttgtggccagcagagaatgttgaaaacacacgcttggaaacatgctggggaggttgattgctcctatccaatctttgaaaatgaaaatgaacccctaggcctgctggattcttcagcagctgctgcgcctggtggggtcgatgcagtcgtcattgctattggagagagtgaactgagtatccacaatgggccatcagtgcaagtgcagatttgcagctcagaacagttatcatcttcatctcctttagaacagagtgcagaaagaggagtacacctaagtcagtcagttaccctggaccccaatgaggaagaaatgctagaagtgatttctgatgcagaggagaatctgattcctgatagcctgcttacatcagcacagaaaatcatcagcagcagccccaataaaaaagggcatgttaacgtgatagtggagcgattgccaagtgctgaagaaaccctttcacagaagcgcttcctcatgaacactgaaatggaagaagggaaggacctgagcctgacagaagctcagattgggcgcgaaggaatggatgatgtttatcgtgctgataaatgtactgttgatattgggggattgatcataggctggagcagttcagagaaaaaagacgagttaatgaataaaggcctggctactgatgagaatgccccaccaggccggagaaggacaaattctgagtctcttcgattacactcattagctgcagaagcccttgtcacaatgcctataagagctgcagagttgacaagagccaacctggggcactatggagatataaaccttttagatccagatactagtcaaaggcaagtagatagtacattggcagcgtactcaaaaatgatgtcgccacttaaaaactcttcagatggattaactagtcttaaccaaagcaactccaccttggtagcactcccagagggtaggcaggaattgtcagatgggcaggttaagacaggcatcagcatgtccttactcaccgtcattgaaaaattgagagaaaggacagaccaaaacgcttcagacgatgacattttgaaagagttgcaggacaacgcccagtgccaacccaacagcgatacaagtttgtccggaaacaatgtggtggaatacatcccgaatgctgaacgaccctaccgttgccgcctgtgtcactacacaagtggcaacaagggctacatcaagcagcacttacgagtccatcgacagagacagccttatcagtgtcctatctgcgagcacatagcggacaacagcaaagatttggagagtcacatgatccaccactgtaagacaagaatataccagtgcaagcagtgtgaagaatccttccattataagagtcaattgaggaaccatgagagagaacagcacagtcttccagataccttgtcaatagcaacttctaatgagccaagaatttccagtgatacagctgatggaaaatgtgtccaggaagggaataagtcttcagtccagaaacaatatagatgtgatgtgtgtgattatacaagtacaacatatgttggtgtcagaaaccacaggcgaatccataactctgataagccgtac

SEQ ID NO: 275804 - DNA, 758 bp, Homo sapiens
ctctaataagcacaccaagggattctggtgaacagactaatttggggaactgcttaggtccacattattttgtaaaggaatgattgaagaacctttttctgaatttttaaaaataagacaccaatttttttattgtagtaaaatatatgtaatatagaacttaccattttcaccatttttaaatatacaattcaatggtattaagtacaaccatcaccacgcatttccagaactttttcatcatcctaaactgaaaccgtacccattaaacaataactcctcattccctgctcctttccctcccaggccctggtaacctctataacactttctgtccctctgaatttgcctgttctaggtccctcatataagtgaagagataattgatttttaacaaaagcttaattgctttcttgcctggaggcatgggtcggagtgaaggggagcaaacattaattggtgtcttgacctgacaagtcaaggtcacattcggatttactggatttatctcaagcaatagaaaactgtgtttttaaactttggttccatggaatcatacagactccttttattctaattgtttttatcatgacctgtgtgttcacctatgaaattattcatttgaaattgttactgactagttggtgatattcaatctgattttctcatgaaaattaataagtatgtttctgaaaatctcctctcaattatgtcattctaaacaatttctgcaatgttaaggcccagcagaaaaaaaa

SEQ ID NO: 275805 - DNA, 418 bp, Homo sapiens
agaatatcacatagtattaggttggcgcaaaagtgattatggtttttgccattactgcagttacttttgcacctaagattcagtttgttgaagagattaattcacattttttgggtatgctaattatagataattcttatccttaaaacagtttcactaaaaagttctaaataatactgttttactgcctgattcagcatatgcttgaaaattatactgtacttcttaccagccctgaatttgtgctggccgtattttcctaattgggcctgattggtaaggttttcttctgtatggtcttattttttcatcagtattgtactggtgtgggattatgggttaatgtcaggtaggagagaaatgttgaagagagaatttttgtaacaggagaactcaaggttcttctaattcagatttg

SEQ ID NO: 275806 - DNA, 420 bp, Homo sapiens
actgttataggaggctggaaaaatggtgacctgggtgatgtagtggtgaacacttggtaaactgttgctgtaatttagaagatagaaaatgtacctaatgaatcttggacttgggcaagatggtttccaggcagaaggataaagtgtgagctctttcattttagctgcatatataataaggtactatacaaaagcgatgtgctcagagaaaaaccaatacagtgtaaataccatgcctctttcaaatactctgggaaagaaaaaactgaaaaagagattaagcaaatccctttggcaataagttaatcgttgaaacttcatgatgggtactgcaaatggagcctcataataccatttgttctttttgtgtattttcataattaatttttttcatgattaaaagaaaatccttcctccaca

SEQ ID NO: 275807 - DNA, 427 bp, Homo sapiens
tgtgctgcaggcaaatctgcttcctacactcacttcccaaatacctctggaggcatccaatacttcattcaaacgcactcaaggcgaagcgctcaaaccgtcactgaacatttctctggcaggttgccagtacttcattcttcttgttaatggtgacagagaaaattacacaaagcatccaggatgctgatatgccacttgcttcacagtttacttcaaagtcccctcagagttttccgaattttactttctggaacaaagaatattattggcataagcatcaagtatgcagttaatagtgagcaatttctgaatttttgagtcagaagcaatctgtcagcaagtaatagccaaaggccctgtagtaataggcttagttggcccaggcttatttctctaattcactgattctcttgcatcaaaacag

SEQ ID NO: 275808 - DNA, 380 bp, Homo sapiens
taggtatccatttgccagataaattccttgtgaggtagtgagttccctgttttggaaagggtgtgttcgcagagaccccttatcagaacagttgtaaaggtgggctttaccctgagaaacacattgggttttggcactccctcactccaaaacctcccatggctccctactgcctacaggacacatctggtcctcctgacagcccacaggccctgcgcagtctgacactgtcccttccttccaatgtccccctcaccccagccacgctggcctcttcactgaccctccccacggaagccaattccctgccgcagcgcatcggaccttgctatatcctctctagaatatcactccttgctcatccccaggtgtggatgggg

SEQ ID NO: 275809 - DNA, 134 bp, Homo sapiens
tcagagcaaacttaccaactgtcctaaatgcttctcctggatgctatccccaaaggatgtacttaataactaacttctgaaaaatgaaaataaaagcagtcatgaaggacaggagttttccctgtttttgcatt

SEQ ID NO: 275810 - DNA, 573 bp, Homo sapiens
aaaagaaaaaaaaaaaacagtctttgagtactatgttcaatttactaaaaatatctagaaaactaaagtgttcccaagggcaaatctttggtgtgacagatgtggaatgatatccacaagctgaagggtctgtcttggaaaagcattctgcagctgcttcaacaagagtactgggtgtcatttataattcatgcaagtatattgaagctttctgctgtcgtccaagaaagatggttttcaaagctacagagtgcaataatccaatattccttgtagagagtcccatatatctcatatagattttacactggagatcatttccatgctgatgacctcaagaatacaatgtgatattttcagaaaacacagatttatgctatgtgctatttctgtgggcttgggggacaaccattagatcattaagttgaaggtatatttctagtcagacttaatccacattgcagtggtcactacaaaaaaaatgtgtatctaaatgcctcaagaacttcagtttttgtgttcaacatattttgcagtggaaaatgagtttgatgatcagagtgtactcctata

SEQ ID NO: 275811 - DNA, 1306 bp, Homo sapiens
aggcgacattgactacagcaccgtgctcctcggcatgctggtgacgcaggacgtgcagctcgggctcttcatggccgtcatgccgactctcatacaggcgggcgccagtacatcttctaggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagtttatcagttcatagtttttttagtaaagaagcaaaattaaaaggcttttaaaaatgtacaacttcagaattataatctgttggtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 275812 - DNA, 1505 bp, Homo sapiens
aggcgacattgactacagcaccgtgctcctcggcatgctggtgacgcaggacgtgcagctcgggctcttcatggccgtcatgccgactctcatacaggcgggcgccagtacatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtagtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagtttatcagttcatagtttttttagtaaagaagcaaaattaaaaggcttttaaaaatgtacaacttcagaattataatctgttggtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 275813 - DNA, 1062 bp, Homo sapiens
aggcgacattgactacagcaccgtgctcctcggcatgctggtgacgcaggacgtgcagctcgggctcttcatggccgtcatgccgactctcatacaggcgggcgccagtacatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtaagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagtttatcagttcatagtttttttagtaaagaagcaaaattaaaaggcttttaaaaatgtacaacttcagaattataatctgttggtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 275814 - DNA, 399 bp, Homo sapiens
attaatttccacaggggcctctctgtcccctggtccctctcatagtgcctggcccatagtaggtgcctaagaaatattaggtgtgctgaaagccttaggaacttgtaatttactagcactgaatatttatgactttgtggaaaactcaagacattagcctccttccctccttcctggagagagacagtaggaaaaatcaggtctattagctgatcccattaataacagtaaacatttgtgagccattgatctacactgtctcataaaattctcacatagctctgtgagtaactaccgctatcatcaccattttacagaagaggaaactgagactcaatttgttagtgaaagtgcccaaagttcacaacactaataaatattccagccaaaattaagacc

SEQ ID NO: 275815 - DNA, 333 bp, Homo sapiens
gagggagagcatcaggaaaaatagctaatgcatgctgggcttaatacttaggtgatggattgataggtgcagcaaaccaccatggcacacgtttacctatgtaacaaaaggcacatgtaccccagaacttaaaaaataccatgttccttcacactgcaggacctaagtacatgttgttcctttacctggagtatactgactttttaagcttagtttaattatctcctcctgctcaaagttcatataccccctcaatagtcatgttctaaagaaagcattctctatgggtcagtctctctattaagcattttagtggcaccacctccttcgtaa

SEQ ID NO: 275816 - DNA, 623 bp, Homo sapiens
tcattttacatggatgccgattgcgcctcactcatgttctccttaaacccatcctttttgtgcaaagctactgcttcctgatgtccataactcaaggcattttttttttcgcttggtgtagtttctgaaatgtgattatttaatgtttgccaagatgtttggaatagagtaactttcaactaatcaattgattgtgactttcttcttttgtagtttttgtttttaaaattgctttctgtcaaacccatctataattcccccagaatatatttatatggactaaggcttaccaaaaataaggaaaatcggagaaactgccaccgccaggaggagccaaggggacatgatgactaaatgtaatctggtttcatggaggggctacctagaaaaaagacattaagggaagactaaggaaacttgaataaagtatgggctctccttaataatagtgtaacaaattcattgtaacaaatgccccatactaacgtaagatgtgaataatcagggaaactggatgtgggacatatgggaactccactatcttcaaaatttttctgtaaatgtagaactgttctaaaacaataaagactataaaaaaataataaagactattagaaaaaaaa

SEQ ID NO: 275817 - DNA, 455 bp, Homo sapiens
ccttctctaaccttgtttgtaaatctaccaaacctcacctcaaacagtgttctccttaaacccatcctttttgtgcaaagctactgcttcctgatgtccataactcaaggcattttttttttcgcttggtgtagtttctgaaatgtgattatttaatgtttgccaagatgtttggaatagagtaactttcaactaatcaattgattgtgactttcttcttttgtagtttttgtttttaaaattgctttctgtcaaacccatctataattcccccagaatatatttatatggactaaggcttaccaaaaataaggaaaatcggagaaactgccaccgccaggaggagccaaggggacatgatgactaaatgtaatctggtttcatggaggggctacctagaaaaaagacattaagggaagactaaggaaacttgaataaagtatgggctctcctta

SEQ ID NO: 275818 - DNA, 689 bp, Homo sapiens
gggcgacaagagcaaaactccatctcaaaataaaataaaataaatcaggaacagtaagaactgccgttcattgagtgcttattacatgctgtcacattgctgagcagtttacacacgttgtctctattcatcctcctgcaaccctaacaggtgggacccctcttagcctcattttattgatgaggaaaccaaggctcggagaggttaaggaacttcctgcagctcacgtagttagaaactggcgaagctgattggatctaggcctgtgtgatcctgagcctacactcaggaccgttctgatcctgaccagtacttactgatttggggtctgagaagacagtaatgagcaagggcccccagagaagttttctgaccttcacaaagccctgctgagatcttgacctctgttcttaagaggtggatcttgcctcagttatgctcagccatttcattacacaggaagacctcattcttccttacattgcaatttattgttttttaaagaaactggccttgtattgtggaaataacattggaaaatggagattaaaatgggtaatggaaataacaatcagtaatggcttaagaacagaagcttgattggggaaaagtcttccgaatagaaagatgatcaagtgggaagaaaataaagtggaactttgagtttgaaatggctcactcatgcctgt

SEQ ID NO: 275819 - DNA, 249 bp, Homo sapiens
ctagaactgggaatataatgatgaaataggaagtcatagtctttgccctcaccaagcttccagcaggcaggtggaggagggagacagacaattccacagtaagtgcggataagggaattacagggtttcataggaatgtaaggatgggtacataagccagacctgctgaatcagggaaagcttcccagaggaaatggcatctaaactgagatctaaaagctgaagaggaattgggacaattaaaatagg

SEQ ID NO: 275820 - DNA, 254 bp, Homo sapiens
gcaatccacccgccttggcatcccaaaatgctgggattataggcatgaaccactgcgcctggccctcagcctcttaaaaagaggaatccgcctctgctgtcactcattatctaccccactgccaccccagatattccacagatggggagccagatgccggcgtgggccaaaggcctttccctttgacccccagcccccatcccacccacccaataaaacaaagaagcaaagagaaagaaacaacgctttcctac

SEQ ID NO: 275821 - DNA, 530 bp, Homo sapiens
tgggctgcaggtggctacagtcccatgattccatggatttcagacccctccaaagcacagggctcagtgcttatccaagtctgagggccccccataaccacatcttccccagcagatgttctttgcttcaggcagtcatcaaagttccacttcaaagagttgctaaccaaataagcccacaatcttccttttttgttgttttgaataagtaatgcctttacacatatgaaattaaaaagagaggccgggcatggtggctcacgcctgtaatcccagcactttgggagggcgaggtgggcagattgcccgaggtcaggagatcgagaccagccaggccaacgtggtgaaaccctgtctctgctaaaaatacaaaaatcagctgggcgtggtggtgggggcctgtaatcccagctacttgggaggccgaggtaggagaatcgcttcaacctgggaggcagaggttgcagtgagccaagattgcaccactgcactccagcctgggggacagtgtgacagactgtctcaaaaaa

SEQ ID NO: 275822 - DNA, 204 bp, Homo sapiens
gcatgtgtgtaggcagcggatacaagaaatcaccaggtcacttggactgtcacttccctccccccaaccaaactgaaactctttaaatcaaatacctcatgaattctccatgtgacaggctccaacaatttattcaggttcttctcgaggaaagctggtcattccctacttttgctaacacctttcgctggcctacagcacatg

SEQ ID NO: 275823 - DNA, 444 bp, Homo sapiens
ttaccagtgactccaaaatctcttatttgcagcctaaacttctttccagaactccaggtatgaaagtctaatggcttaatatttctgcctagatacttagtaggcatttcaaagtgaacatagagatgtgtcaaagttaacatagtcaagagaataatcttgattccatctttactcctgttccacatcctgttcctcaaaattattttacccaattttatctcagcaaatggtactgtgcttacctagatgctcaagccaaaatataattttcatccttcattcctctttattcctatttcatcatatccaatccatgagagagtcttgtcaactttatccctcaaacatatcccaaatctgtccactgctctcatatctataatagtcccttactgaaggcactgtcatcaagccctgtttcctggactcctgcaatagcat

SEQ ID NO: 275824 - DNA, 428 bp, Homo sapiens
tcagcttctttccttccttctttcctctctccctaccccctctcttttcctccttttttccttcctccttcattctcatcccttcctccttttttggtccctccctctatctctctgtcctcctttctcctcttccttctttctgtctctctgtaatactacttcatagatggtgttttgtacttctatcaggaagatcataatgtctttctctcttcttgaaagcttagcagtcattaatattcagtaactagattaatttattgggattgaaaaatgatattttaattcaaacattccttcatttattagttagaatacttctattttttggttatccagtggtattgtatgaataggaaaggcaggataaaatatttgaatcttttttttcaatgaacatttataaactcataaacttaaacata

SEQ ID NO: 275825 - DNA, 379 bp, Homo sapiens
tgttaacaaataggtacagggattgataacattaaaaaatatatatacttccttatagagggaaaaacaatcagaatagatagaatcttttagatcaattttacacaaagaataccaaaaaatttaacaacaaaaatgatctcattcaagaggattcagttcacatcctttcctagggtcaaccaaatgactaatgtcaaatccccaaagcacataggtaaaaaaatcttttctccaaaaagaacaaagacatagaatttcaatttcgaaaaatttcctattttctacttttcaataaagttttactgttacatttaacttcccagcagcacagtagagaagtaaacacattctcatgtagaatatgaaacttaaaaat

SEQ ID NO: 275826 - DNA, 217 bp, Homo sapiens
agctggaacacagggggcaagggaggaaagttacacaagataaggctggatgaggaaggtagaggtgagaccatgcaaagcctgaggtcatggtaaggagtttggtcttcattctttgaataataccaagagatagcaggattttaatctaggggtgtagggttataggggtgtaggtgtgtgtgtgtgtgtgtgtgtgtctgtgcgtgcgtgcacg

SEQ ID NO: 275827 - DNA, 2498 bp, Homo sapiens
ataggaggacagtgtgggactttcccaattctacctgaccaaaaaatgagaaattaattttatgataggagaagagatttaaaaaaatgatagaagaggatggaagccaggcacagtggctcacgcctgtaatcccagcactctggaagtacaggcacatactaccaagcccagttcgttattttaagtttttgtagagacaggggtcttactatgttgcccagactggtcttgaactcctgtcaagtgagcctcccacctcagcctcccaaagtgctatgattacaggtgtgagcctccatgcttggatgagatgttgtttttaatgtttttggttttttggttttgttgttttgtttttttgagacagggtctcactctgtggcccaggctggagtgcagtggcaccataatggctcactgcagcctcgacctcccaaggctcaggtgatcctcttgcctcagccaccccttccccggccaccaagtagctgggactatgggcttgtgccaccatgcctggctaatttttttatttttagtagagatggggttttaccacgttggccaggctagtgtccaactcctgacctccaaacggctaatttttgtatttttagtagagacagggttttgccacattgcccaggctggtgttgaactcctgggctcaaatgatccacctgccttggcctcccaaagtgctgggattacaggcgtgagccactgcacccggccctttgtagtgtttttaactaaagaatttgtagagttgcccaggccaggaagcctggtggctctaaagggtaatagaccttgtcagtaacagataaggagtggtaagaggacattactcatattgaagatgaagaccagactttgctgcttcacaggccatgcgctgggttgggccacttcagctccactccattcgttttcctttcctaacttgacaatcagctcactcaccctcccttagtgcctccagtgcctactcctgtcactccaatgtcaacccattgggagttgaggcctgtcactccaatgtcaacccgtgggctgttactttgcgtcatatgatgctgtgagaggccttgctggaatgtcctagggaatccctagtagcagtggctattagtcttctagaaaagaactattgctgctgccttgtgcacatgccccaccttctgggcaagtgggcagcattgcgctcatgaggggctttgcattcttagccaagggcaataaactgggtgggtgatctggcccaaacttgcccctaggctctgctagccctgaatcagcaggcttcagagacgagggtgggtgttataaaagccagtctgtaaagggtaaattccaaatcttgtgccttgttataccaatccttcctgattcccgtttaaaccaactactctatttctgtgctgcctacattttcaatcctcccaagcattagcaaattcctgaaatttcctcatttggtaggccttccataggagtcagctatggacttccataggagttggcagctaaaaccagactgtgagcttctgtctccgttctgatttttgctgcacctcccaggggacagtccccacatgattacaaaagccaggtgccctcatcacccgttacccctgacctgtccacttgttttgaataaaccttcattctccaagcagatccccaaacttccttgtccttgttacacgtctacctcacaacctcacaattcaacaacaggtaaatacctggattcactgatttctttactgtccttctctgagggttgggaaggtgggggctagaaaaggctcataatttttaaactcttgggaattaaacttgggaatttctattcctacagtgttttctctgggatttttagctcactgatcgccctagaatagtgtgaactctccagataggtcctgctgtgataggccaggggagtaggctgtgcagtgacggcttagggtaataagtaatggttggaggacaccagcataggagcagagtttagaacttaagaggacaagaaagctgctcagtggctggcgtatagctgtgaaggtaaccaaacaccaaagagggagtctgtcatttttataaggctggaagcgaatgttccttttctaccttaacatacagtttagggggttgcaccaagacaaagtttccaggctggagggtaatacatatccagcgcgagtgaagtccccactccaacatataccctttttgggtgggtaaacacctctttgcatgtggacagaaaatgtttatacttaaacagacatattttgcatatttttatctggagacttcttctagttttatactcttcccacatctatgccaatgccaccattctaaaacttacactccttttctacccctggtcttttccttgtccttccctacaacttggtagaggtccattttgtcttacttcacacttttttttttttaaataaaacacaaaagtctaaatc

SEQ ID NO: 275828 - DNA, 2043 bp, Homo sapiens
tgagacggagtctcgctctgtcgcccaggctggagtgcagtggcgtgatcttggctcactgaaacctccatctcctgggttcaagcagttctcctgcctcagcctcctgagtagctgggattacaggtgcctgccaccatgcctggctaatttttgtatttttagtagagacagggttttgccacattgcccaggctggtgttgaactcctgggctcaaatgatccacctgccttggcctcccaaagtgctgggattacaggcgtgagccactgcacccggccctttgtagtgtttttaactaaagaatttgtagagttgcccaggccaggaagcctggtggctctaaagggtaatagaccttgtcagtaacagataaggagtggtaagaggacattactcatattgaagatgaagaccagactttgctgcttcacaggccatgcgctgggttgggccacttcagctccactccattcgttttcctttcctaacttgacaatcagctcactcaccctcccttagtgcctccagtgcctactcctgtcactccaatgtcaacccattgggagttgaggcctgtcactccaatgtcaacccgtgggctgttactttgcgtcatatgatgctgtgagaggccttgctggaatgtcctagggaatccctagtagcagtggctattagtcttctagaaaagaactattgctgctgccttgtgcacatgccccaccttctgggcaagtgggcagcattgcgctcatgaggggctttgcattcttagccaagggcaataaactgggtgggtgatctggcccaaacttgcccctaggctctgctagccctgaatcagcaggcttcagagacgagggtgggtgttataaaagccagtctgtaaagggtaaattccaaatcttgtgccttgttataccaatccttcctgattcccgtttaaaccaactactctatttctgtgctgcctacattttcaatcctcccaagcattagcaaattcctgaaatttcctcatttggtaggccttccataggagtcagctatggacttccataggagttggcagctaaaaccagactgtgagcttctgtctccgttctgatttttgctgcacctcccaggggacagtccccacatgattacaaaagccaggtgccctcatcacccgttacccctgacctgtccacttgttttgaataaaccttcattctccaagcagatccccaaacttccttgtccttgttacacgtctacctcacaacctcacaattcaacaacaggtaaatacctggattcactgatttctttactgtccttctctgagggttgggaaggtgggggctagaaaaggctcataatttttaaactcttgggaattaaacttgggaatttctattcctacagtgttttctctgggatttttagctcactgatcgccctagaatagtgtgaactctccagataggtcctgctgtgataggccaggggagtaggctgtgcagtgacggcttagggtaataagtaatggttggaggacaccagcataggagcagagtttagaacttaagaggacaagaaagctgctcagtggctggcgtatagctgtgaaggtaaccaaacaccaaagagggagtctgtcatttttataaggctggaagcgaatgttccttttctaccttaacatacagtttagggggttgcaccaagacaaagtttccaggctggagggtaatacatatccagcgcgagtgaagtccccactccaacatataccctttttgggtgggtaaacacctctttgcatgtggacagaaaatgtttatacttaaacagacatattttgcatatttttatctggagacttcttctagttttatactcttcccacatctatgccaatgccaccattctaaaacttacactccttttctacccctggtcttttccttgtccttccctacaacttggtagaggtccattttgtcttacttcacacttttttttttttaaataaaacacaaaagtctaaatc

SEQ ID NO: 275829 - DNA, 2418 bp, Homo sapiens
ataggaggacagtgtgggactttcccaattctacctgaccaaaaaatgagaaattaattttatgataggagaagagatttaaaaaaatgatagaagaggatggaagccaggcacagtggctcacgcctgtaatcccagcactctggaagtacaggcacatactaccaagcccagttcgttattttaagtttttgtagagacaggggtcttactatgttgcccagactggtcttgaactcctgtcaagtgagcctcccacctcagcctcccaaagtgctatgattacaggtgtgagcctccatgcttggatgagatgttgtttttaatgtttttggttttttggttttgttgttttgtttttttgagacagggtctcactctgtggcccaggctggagtgcagtggcaccataatggctcactgcagcctcgacctcccaaggctcaggtgatcctcttgcctcagccaccccttccccggccaccaagtagctgggactatgggcttgtgccaccatgcctggctaatttttttatttttagtagagatggggttttaccacgttggccaggctagtgtccaactcctgacctccaaacggctaatttttgtatttttagtagagacagggttttgccacattgcccaggctggtgttgaactcctgggctcaaatgatccacctgccttggcctcccaaagtgctgggattacaggcgtgagccactgcacccggccctttgtagtgtttttaactaaagaatttgtagagttgcccaggccaggaagcctggtggctctaaagggtaatagaccttgtcagtaacagataaggagtggtaagaggacattactcatattgaagatgaagaccagactttgctgcttcacaggccatgcgctgggttgggccacttcagctccactccattcgttttcctttcctaacttgacaatcagctcactcaccctcccttagtgcctccagtgcctactcctgtcactccaatgtcaacccattgggagttgaggcctgtcactccaatgtcaacccgtgggctgttactttgcgtcatatgatgctgtgagaggccttgctggaatgtcctagggaatccctagtagcagtggctattagtcttctagaaaagaactattgctgctgccttgtgcacatgccccaccttctgggcaagtgggcagcattgcgctcatgaggggctttgcattcttagccaagggcaataaactgggtgggtgatctggcccaaacttgcccctaggctctgctagccctgaatcagcaggcttcagagacgagggtgggtgttataaaagccagtctgtaaagggtaaattccaaatcttgtgccttgttataccaatccttcctgattcccgtttaaaccaactactctatttctgtgctgcctacattttcaatcctcccaagcattagcaaattcctgaaatttcctcatttggtaggccttccataggagtcagctatggacttccataggagttggcagctaaaaccagactgtgagcttctgtctccgttctgatttttgctgcacctcccaggggacagtccccacatgattacaaaagccaggtgccctcatcacccgttacccctgacctgtccacttgttttgaataaaccttcattctccaagcagatccccaaacttccttgtccttgttacacgtctacctcacaacctcacaattcaacaacaggtaaatacctggattcactgatttctttactgtccttctctgagggttgggaaggtgggggctagaaaaggctcataatttttaaactcttgggaattaaacttgggaatttctattcctacagtgttttctctgggatttttagctcactgatcgccctagaatagtgtgaactctccagataggtcctgctgtgataggccaggggagtaggctgtgcagtgacggcttagggtaataagtaatggttggaggacaccagcataggagcagagtttagaacttaagaggacaagaaagctgctcagtggctggcgtatagctgtgaaggtaaccaaacaccaaagagggagtctgtcatttttataaggctggaagcgaatgttccttttctaccttaacatacagtttagggggttgcaccaagacaaagtttccaggctggagggtaatacatatccagcgcgagtgaagtccccactccaacatataccctttttgggtgggtaaacacctctttgcatgtggacagaaaatgtttatacttaaacagacatattttgcatatttttatctggagacttcatcacagtgtttactacttattgacccacagtctacgccatattcgacgaccaggtatcaaaccgtacgctccgtttccttctcagc

SEQ ID NO: 275830 - DNA, 1172 bp, Homo sapiens
ccactcccctctcctctgcctcacagaactcctgattctgtcttctttctctctatatatatatattttaaaatgtttaaaccaactactctatttctgtgctgcctacattttcaatcctcccaagcattagcaaattcctgaaatttcctcatttggtaggccttccataggagtcagctatggacttccataggagttggcagctaaaaccagactgtgagcttctgtctccgttctgatttttgctgcacctcccaggggacagtccccacatgattacaaaagccaggtgccctcatcacccgttacccctgacctgtccacttgttttgaataaaccttcattctccaagcagatccccaaacttccttgtccttgttacacgtctacctcacaacctcacaattcaacaacaggtaaatacctggattcactgatttctttactgtccttctctgagggttgggaaggtgggggctagaaaaggctcataatttttaaactcttgggaattaaacttgggaatttctattcctacagtgttttctctgggatttttagctcactgatcgccctagaatagtgtgaactctccagataggtcctgctgtgataggccaggggagtaggctgtgcagtgacggcttagggtaataagtaatggttggaggacaccagcataggagcagagtttagaacttaagaggacaagaaagctgctcagtggctggcgtatagctgtgaaggtaaccaaacaccaaagagggagtctgtcatttttataaggctggaagcgaatgttccttttctaccttaacatacagtttagggggttgcaccaagacaaagtttccaggctggagggtaatacatatccagcgcgagtgaagtccccactccaacatataccctttttgggtgggtaaacacctctttgcatgtggacagaaaatgtttatacttaaacagacatattttgcatatttttatctggagacttcttctagttttatactcttcccacatctatgccaatgccaccattctaaaacttacactccttttctacccctggtcttttccttgtccttccctacaacttggtagaggtccattttgtcttacttcacacttttttttttttaaataaaacacaaaagtctaaatc

SEQ ID NO: 275831 - DNA, 1525 bp, Homo sapiens
  misc_feature (1460)..(1460): n is a, c, g, or t
  misc_feature (1516)..(1516): n is a, c, g, or t
  misc_feature (1523)..(1523): n is a, c, g, or t
ataggaggacagtgtgggactttcccaattctacctgaccaaaaaatgagaaattaattttatgataggagaagagatttaaaaaaatgatagaagaggatggaagccaggcacagtggctcacgcctgtaatcccagcactctggaagtacaggcacatactaccaagcccagttcgttattttaagtttttgtagagacaggggtcttactatgttgcccagactggtcttgaactcctgtcaagtgagcctcccacctcagcctcccaaagtgctatgattacaggtgtgagcctccatgcttggatgagatgttgtttttaatgtttttggttttttggttttgttgttttgtttttttgagacagggtctcactctgtggcccaggctggagtgcagtggcaccataatggctcactgcagcctcgacctcccaaggctcaggtgatcctcttgcctcagccaccccttccccggccaccaagtagctgggactatgggcttgtgccaccatgcctggctaatttttttatttttagtagagatggggttttaccacgttggccaggctagtgtccaactcctgacctccaaacggctaatttttgtatttttagtagagacagggttttgccacattgcccaggctggtgttgaactcctgggctcaaatgatccacctgccttggcctcccaaagtgctgggattacaggcgtgagccactgcacccggccctttgtagtgtttttaactaaagaatttgtagagttgcccaggccaggaagcctggtggctctaaagggtaatagaccttgtcagtaacagataaggagtggtaagaggacattactcatattgaagatgaagaccagactttgctgcttcacaggccatgcgctgggttgggccacttcagctccactccattcgttttcctttcctaacttgacaatcagctcactcaccctcccttagtgcctccagtgcctactcctgtcactccaatgtcaacccattgggagttgaggcctgtcactccaatgtcaacccgtgggctgttactttgcgtcatatgatgctgtgagaggccttgctggaatgtcctagggaatccctagtagcagtggctattagtcttctagaaaagaactattgctgctgccttgtgcacatgccccaccttctgggcaagtgggcagcattgcgctcatgaggggctttgcattcttagccaagggcaataaactgggtgggtgatctggcccaaacttgcccctaggctctgctagccctgaatcagcaggcttcagagacgagggtgggtgttataaaagccagtctgtaaagggtaaattccaaatcttgtgccttgttataccaatccttcctgattcccgtttaaaccaactactctatttctgtgctgcctacattttcaatcctccctcatccgctnatccatgccctcatccgcttatccaatgggggatcctggagattcccatagaggcngcctccngt

SEQ ID NO: 275832 - DNA, 189 bp, Homo sapiens
gcctttattttattttttagagatggtcttgctgtgtcacccaggctggagtgcagtgatgcagtcgtagtctactacagtcttgaattcctgggcccaagggttcttcccacctaagcctcccaagtagctggaagtacaggcacatactaccaagcccagttcgttattttaagtttttgtagagac

SEQ ID NO: 275833 - DNA, 1377 bp, Homo sapiens
gctgatcttgaactcctgcacctgcctcagcctcccaaagtgttgggattacaggtgtgagacactgcgcctggctatattttactatttggaaatcacaatgcatcttaaaattgatggcttcttgcaaccactttcaaccaggtgcctgtcatgatttagtgctagcatcaaggcaggttagttatgaagaaatagagtgtgtgtttatatactcacacagttagaaatcgacccttttaaaaattatttctttttgaaaataatgtcagttccatcagaactaatgcattgataactaaatgtctgtggttccttgtcataggtctacacctgacctctctattttgtgcacataggggattcgtaatatcactgttcagtcagtcattcaccatctagtgatcatcattctacatgattgcactttttcaaaggcataaaaagccaacagttgcactcttaataatcaactgtaacacaaagcagagtactttgggagttttaacaggatatattattggtaactggctattatgccactccctctgggtgccacatttgcctgttaaccaagaaatgtagacatggtgccttatcccaacatttctgaaattatatctcaaggaatcaccagtgcttactagtacttgacaatgaaggaggattttacagttaaagaagcttataaagtagcatctactaaatcccctcctaaggaacaagcaaaagcacctcaccagcttatcaaaagactaaagagaagtgaaaaaaaaaaaaagacggccgggcgcggtggctcatgcctgtaatcccagaactttgggaagccgaggcgggcggatcacgaggtcaggagatcaagaccatcctggctaacacggtgaaaccccgtctctactaaaaatagaaaaaattagccgggcgtggtggcgggcgcctgtggtcccagctactcggggaggctgaggcaggagaatggcgtgaacccgggaggcagagcttgcagtgagccgagattgcgccactgcactccagcctgggcgacagagcgagactccgtctcaaaaaaataaaaataaaaaaagactaaggagtattctagtgaagaaaatggttgaactttgtttaaactggtgtatggcaaacttcactgttgaaatacttattcccatgacctattatctttgtaggtgggtgaaattgcattgggaactgctgctataaccaaaagagaatttcagtcaccatgtctggttgttagctatgatggaatggcagcatcatggtctcagttatgagtgaaaatctttgttgtagctaagtagtggtgcctcctgagttttattaaatgccgtttcactatctttttctgca

SEQ ID NO: 275834 - DNA, 864 bp, Homo sapiens
cctcttggccgtcgggacttgtactgttggtgactccgtctccttagacggtggagcctgcgtgacccagaaaggccgcctcgggacccagaccaggatttccatcagctcccctggctcgcaggccttctgacttctgactcaccatcagctctcctggatccagcttgccaatggcagatcgtgggactccttgccctctaatcgcatgaaacaatgcccacaagagaaaataaaagcagtcagaggagaatggagaatttcccctattccccagcatgtggagccatggactctgccttctcccagtcaagatggggcaggtctcactatgttgcccattctggtcttgaactcttggactcaagcaatcctcccacctcggacttccaaagtgctggaatcacaggcttgagataccatgcccagccaatttattgtggttgattccagatcctggctactgtgcatagtgctgcagtcaacatgggagtgccgatatctcttcaatatactgatttccttttccttgggtatctacctaacaagatggtgagctccttagagggaagtatagtacatatttcctccatgtctccagtacccaacacagtgcctgacgttgagagggctcttaataagtgtttgtgaaagactggtagagcaatgccctatgaaacaagaagctggataacactgtaaggactcagaaggagagaggagtgtggtctacactgcacatctctgccaagctgggcacgggatttgaagttccacaccactgagccaaaacacatcaagacccctccccaacccggggatcggtggtaagcacacatcctattccagcagtgatggccccgg

SEQ ID NO: 275835 - DNA, 655 bp, Homo sapiens
tccccgttacctgcgggcggcggcgccgggcccggaggcctgctgctcctcctccttctcccgccaggctggggcggcgaggcggcggcggcggcggcccggggggagggggcggagcgcggctcgctgcctctctcctcccccgggaggctcaggggcccctatctcgggccgccgcgcctaggcccgtgagcagcctgtggtggggcatggcggcacagccaccggcgtgcccgcgaaaagggcacactagccagctgttttgccacgagagtacaccgaacaaaggagacagggttatttataacctgacacgtctaccctactgctgtgtgtggtttccattgcctggaataggacctgaaattctgtatttgtcccaactggctagcaacttagaactttctaaaagagacaaaagcagaggagaacaaaggaaggaggcagtaacttgtggaatgctgagaaaggcctcgggacccagaccaggatttccatcagctcccctggctcgcaggccttctgacttctgactcaccatcagctctcctggatccagcttgccaatggcagatcgtgggactccttgccctctaatcgcatgaaacaatgcccacagtatgtctcctattaaataaatatatatctaatctct

SEQ ID NO: 275836 - DNA, 331 bp, Homo sapiens
cctcttggccgtcgggacttgtactgttggtgactccgtctccttagacggtggagcctgcgtgacccagaaaggcctttttgtagggaggtcgaaatagaaacacttcagcccctcttcggcgagggaggttagttggtaaggtgcccattgttcacccatggaaacaggcctgccaagggccgccccgcagacagcacttgcctcggtgacctggcaggacgtgcggttcttgagatgagtggagaaacggactcccaggtccctctcgttcttccaacacagggacagctagagctgctccaaaaatataccctacttcttccacaac

SEQ ID NO: 275837 - DNA, 383 bp, Homo sapiens
ctgtgaggatgtttctggaagagattagcacttgaatcagtagattaagtagagatcaccctcaccaacatgggtgagtgtcattcaatccattgaggacctggatagaacaaaaaggtgaaggaagggtgcatttgttctctctgcttgaggtgggacatccatcttcttccaccctcagacagctgtgctcctgattctcaggcctcgggacccagaccaggatttccatcagctcccctggctcgcaggccttctgacttctgactcaccatcagctctcctggatccagcttgccaatggcagatcgtgggactccttgccctctaatcgcatgaaacaatgcccacagtatgtctcctattaaataaatatatatcta

SEQ ID NO: 275838 - DNA, 174 bp, Homo sapiens
acccagaccaggatttccatcagctcccctggctcgcaggccttctgacttctgactcaccatcagctctcctggatccagcttgccaatggcagatcgtgggactccttgccctctaatcgcatgaaacaatgcccacagtatgtctcctattaaataaatatatatctaatc

SEQ ID NO: 275839 - DNA, 869 bp, Homo sapiens
tccccgttacctgcgggcggcggcgccgggcccggaggcctgctgctcctcctccttctcccgccaggctggggcggcgaggcggcggcggcggcggcccggggggagggggcggagcgcggctcgctgcctctctcctcccccgggaggctcaggggcccctatctcgggccgccgcgcctaggcccgtgagcagcctgtggtggggcatggcggcacagccaccggcgtgcccgcgaaaagggcacactagccagctgttttgccacgagagtacaccgaacaaaggagacagggttatttataacctgacacgtctaccctactgctgtgtgtggtttccattgcctggaataggacctgaaattctgtatttgtcccaactggctagcaacttagaactttctaaaagagacaaaagcagaggagaacaaaggaaggaggcagtaacttgtggaatgctgagaaaggcctcgggacccagaccaggatttccatcagctcccctggctcgcaggccttctgacttctgactcaccatcagctctcctggatccagcttgccaatggcagatcgtgggactccttgccctctaatcgcatgaaacaatgcccacaagagaaaataaaagcagtcagaggagaatggagaatttcccctattccccagcatgtggagccatggactctgccttctcccagtcaagatggggcaggtctcactatgttgcccattctggtcttgaactcttggactcaagcaatcctcccacctcggacttccaaagtgctggaatcacaggcttgagataccatgcccagccaatttattgtggttaagtatatataatagaatttaccattttaag

SEQ ID NO: 275840 - DNA, 391 bp, Homo sapiens
agtcgccttgtcttagttcacaggcttgtattgcaggactggcttctgttatatagcagggctcacatactctctcctacagggatgtaggtggtattcagactagttccttttcctgctgattatactacaggatgtgggttatccagagcagagtgcattggtcgaagttgcaagagctctcagagagcttccataggtttggagacccatacgattcccacaggtgggccccttgagcctcagcaaccaggacagagggccactgccccacggccactttggcctccatctgtaacaaaatagtcaagtaaccctgttggatctagggagaagccctttcccaacactgggtgctagctttacccaacgttacccaacccacttcacc

SEQ ID NO: 275841 - DNA, 505 bp, Homo sapiens
ttcatattcaagagcttcgctttcctaaacaaatccttagcttctataccagactagccatttcttagaaatgggatcatcttgatttgcacagcaacctcaataagacctcaatagtccagcctcctcttcccaagtttcaggctttatttacgcgacttgggtgaggtatataggatgggcgtgccgtggctcacgcctgtaatcccagcactttgggaggctaaggcaggtggatcacttgaagttaggagtttgagaccagcctggccaacatgctgaaacccgtctctactaaaaatacaaaaattagctgggcgtggtggcaggcacctgtagtcccagctactcaggaggctgaggcaggagaattgcttgaacccggggagcaagagattgcagtgatcacaccactgcatttttctttttttaattttgggaaaagacacacataaatttatttatttgtttatttatcttaattgagacagggtcttgctccatc

SEQ ID NO: 275842 - DNA, 434 bp, Homo sapiens
ctgattatgcaggacaaaaacataattctccttatggatgttattgtcactgtgccacactgccataatggtagtgttcagaaaaaaatatggctgaaaattcatataacattcaaatgttgtagattcagaactatttcctttgtagacattttaatattcatgctgcttttagctcagtttttactgttctgctaaaggaatgcattggtctctccctctgcctcagtgtgatagcaggcccaatctaatgtttatagtcatagtgtagaattatgtatttaggagtttttggaggttattaatcatttccttcagagttctaattttctaattccatagcctgcttcagtccttatcttttccatatctttatagggtttgattaacctccgattctagaaacttggaccttgcagtctagtttttcttgt

SEQ ID NO: 275843 - DNA, 892 bp, Homo sapiens
agcgcgcgacctccggcgccattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagtt

SEQ ID NO: 275844 - DNA, 310 bp, Homo sapiens
agcgcgcgacctccggcgccattttgtagagaaacaagcggagttaaccgaagagggggtcgaggagagccggagtcggggacccaggagtttcctgtgtccagcgctgccggagccgcctgaggtgaccagcacccatgcagaaactacctagaagttgccaagctatcagtcaactcagcatacaaaaagaaacttaccattctaaggatcttagaagttgtatgccaggaaatgggatgaagaccaaatgtatatctcacaataaatattacagtaatgttgaagtaattatttgaaatataaaagt

SEQ ID NO: 275845 - DNA, 1162 bp, Homo sapiens
agcgcgcgacctccggcgccattttgtagagaaacaagcggagttaaccgaagagggggtcgaggagagccggagtcggggacccaggagtttcctgtgtccagcgctgccggagccgcctgagatggagtcttgctctgttgcccaggcttgagagcagtggtgtgatctcggctcactgcaacgtccgcctcccaggttcaagtgattctcctccctcagcctcccgagtagctgggattacaggcgcgtgccaccacggctgggtgaccagcacccatgcagaaactacctagaagttgccaagctatcagtcaactcagcatacaaaaagaaacttaccattctaaggatcttagaagttgtatgccaggaaatgggatgaagaccaaatgtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagtt

SEQ ID NO: 275846 - DNA, 1005 bp, Homo sapiens
agaaacctggcatttcttatcaacagtggttgagctaccttactatctttttagagtcattagtaacattttaggtactaacacagagacgatggtagtttaaccctattctcttctaattattaatttgcaactagttgtgatcaattagttgtaaacaccactgcgcctggaccagcctcctttttccttttaatttaaaaatctggatttgtgtgtgtgtgtttttttaaacaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattttatctcgacgctgtcctatgccattgataatccattgcactatcagaagagtttaaagcctgcaccccacttatttgcccagctgagtaaagtgctcaaattaagcaaagtacaagaggtaatttttggccttgccctgttgaattcttccagctcagatcttagaggtttcgctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagtt

SEQ ID NO: 275847 - DNA, 204 bp, Homo sapiens
tattttttgtatattaacagctttgtggaatctttaccacagtcaattttagaagattttcattgccacccaaaagaaagtccccatcccttagctataactccacaatctttgattctctctagcctgagacaactattgatctactttctgtctttatagagttgcatattccagacatttcacgtaaatgtaatcatgcat

SEQ ID NO: 275848 - DNA, 500 bp, Homo sapiens
acattctcatatcacacactcccttttctgtgcacttctaaagcagttattttcggaacctctttttgctcttaatcatgtagagacttttcattttcctaaatatatcatacctaaacaaataactcatagaggtactgtgggttatggtttgccatttgaaccatgcatcaaccttctggagaatcttttaaagtatatacatttttccagagtaaaattaatttttttctaaaacacgtgaagtagtttttattaatatattaatagttgtatatatttatgggatgcacgtgatattttgatttgtgcacatacaatgtgtaatgatcaaatcatggtaattgggatatgcatcacctcaaacatttatcatttctttgtgttgggaacattctaaatcttctagttattttgaaatatacaacaaattcttgttaactgtagttgccctactgtgttattgattagctataataaataagttctagtgttactga

SEQ ID NO: 275849 - DNA, 679 bp, Homo sapiens
tctctctctctctctctgtctctctctctctctatatatatataaaacttgaattcatactgatgtctccaaatgtaatccagtaccccagggatcattctagtctttccttattgcttatctctctccaagagtgagatcctgtctcctgccatatactagccatttacttagttattcaacccttgcatacagtttcataattattaacccatacttcccactttcacctatttgtaatgtttgtttatggcatctttcatcagacagatatttgaaatttaatatagtttaatcatcagtcttttcctttaagctcttgagttttatatcttacataagaaagctttctcacccaccactaccaccagattataaaaatattttagtttcattttatatttaaatattaaatctatctagattttatttggggttatataaaatgcaaatataaccttttttttcaaatggctatctgaagatcctaagtgcttattattatcagtcaacccattcctcactgctttgcaatacatgggtctgtttctagactctatattctactggtctatttctgtgccaatttgagatcattataatttatgtaaccttaaaatatgttctgatatttaatagagaaagtctctactattgatctttttcaaaaatgaaaaaa

SEQ ID NO: 275850 - DNA, 187 bp, Homo sapiens
acaagtatgtctgtgttcaccactcctgttttacatagtattgtaaattctagccactggaattagtcaagaaaaagaaaatgcatacaggttgcaaaggcagaaataaagctgtcttgttttgcaggtgacatgattgttatgtagaaaatctcaaggaaatgacaaataaatttcctagaacctg

SEQ ID NO: 275851 - DNA, 458 bp, Homo sapiens
acagtatgagcaggcgtcgtagccaaatgaagttggatctaacaacagccgcccagctttaggacttccaaattacactaaacctttcactttgtttgttcatgaatgtaataatcaggaacacggtgctaaacataggaccactgcatactatagcctgcaattaggcccagtctctaaggcatatcctaattgtttaaaagcagtagcagcagccaagctggtagaagcttcatcagatctggttttaggaaatgaacttaatttgcaagtcccacacgctgtggaaagtctattaaattccaatcaaacccagcatttttcagtgagtagactaacatcttatgaattacttctcctatctccttcttatcttcatctaaaaggctgtaatctacttaatgctgctactctgttatctctgcctgatgatggtgaagaccacaacagtgatgaga

SEQ ID NO: 275852 - DNA, 313 bp, Homo sapiens
ctctccaatggcaggagagttgtactcagtgatttaccccccagggcctaggagcaattcctgacacctggaagatgctcactaaatatttgttgaatgactaagtgaactataggtaaaaatactgactttagtgattgttatgtggtggcatttgttccctctctgagcccacctaggatatgaactatatgggcttcagggtctgagttttgtgattcaggaaactgaaagtggaaggtgttagaagattgtagcctctgctcctgtggggttcttggaagtaagactctccctgggcacccgtgacttg

SEQ ID NO: 275853 - DNA, 342 bp, Homo sapiens
tgaacaaataaacttattgttccatctttcctaccgtatccttctccatagcacttaccacctcacatgccgaattttttgcttgtttgtcttatattcctacgtgcaaacttgtccaacccatagcccgcaggctgcatgcaccccaggatggctttgaatggggcacaacacaaatttgtaaactttcttaaaacattgtgagatttatgtgagatttatgcatggacctttttttttttttttttttagcccatcagctattgttagtgttggtgtattttatgtgtggcccaagacaattcttcgtctttcattatggcccagggaagccaaaagatt

SEQ ID NO: 275854 - DNA, 698 bp, Homo sapiens
ggcccgttccaatggcaactctgccaaggcgcctatgagagcctcttggcttttacctggtctgcgagaaatcaaactttgggcacaagtcatgaagccgacaagcccgggagacacagtgtcagaattacaaggaacactacaaggcctgttagagaagaaagggtagaatcccgagaatgttttccccacagtgctgataaggagagaccactatcccatctactgctacagctctggagacagagctctcccacctgtcatatagaacacaaggaccaatctgcagagaaagagcatccaaacctgatccagtggacactggggaaaaactcaccacagctgagtgtggaaaaacaaggccaacacacacatctctgcacagatacatctcccataaagaaactaaagtgttaatttacagggcactgttgcagacccacttcagctggaagctaggaacatggacaaggagcctctctaccaccaagggagagagaggaatgtgctcttgtcctggcattgcatccacaggaggggcaggaaattctttgaaggtcagtaaccccataccccaattaacagtgcttaagtgtgaggctccctcagaacatcagagatatcctcactccctcacccctgccaccaggctaagaagcatggagcaaaaaaaaaaaaaaaaaaaacagaacaaaaca

SEQ ID NO: 275855 - DNA, 739 bp, Homo sapiens
ggcccgttccaatggcaactctgccaaggcgcctatgagagcctcttggcttttacctggtctgcgagaaatcaaactttgggcacaagtcatgaagccgacaagcccgggagacacagtgtcagaattacaaggtgagatcagccgcccggccaagctatcttctcgctagcaggaacactacaaggcctgttagagaagaaagggtagaatcccgagaatgttttccccacagtgctgataaggagagaccactatcccatctactgctacagctctggagacagagctctcccacctgtcatatagaacacaaggaccaatctgcagagaaagagcatccaaacctgatccagtggacactggggaaaaactcaccacagctgagtgtggaaaaacaaggccaacacacacatctctgcacagatacatctcccataaagaaactaaagtgttaatttacagggcactgttgcagacccacttcagctggaagctaggaacatggacaaggagcctctctaccaccaagggagagagaggaatgtgctcttgtcctggcattgcatccacaggaggggcaggaaattctttgaaggtcagtaaccccataccccaattaacagtgcttaagtgtgaggctccctcagaacatcagagatatcctcactccctcacccctgccaccaggctaagaagcatggagcaaaaaaaaaaaaaaaaaaaacagaacaaaaca

SEQ ID NO: 275856 - DNA, 1085 bp, Homo sapiens
ggcccgttccaatggcaactctgccaaggcgcctatgagagcctcttggcttttacctggtctgcgagaaatcaaactttgggcacaagtcatgaagccgacaagcccgggagacacagtgtcagaattacaaggaacactacaaggcctgttagagaagaaagggtagaatcccgagaatgttttccccacagtgctgataaggagagaccactatcccatctactgctacagctctggagacagagctctcccacctgtcatatagaacacaaggaccaatctgcagagaaagagcatccaaacctgatccagtggacactggggaaaaactcaccacagctgagtgtggaaaaacaaggccaacacacacatctctgcacagatacatctcccataaagaaactaaagtgttaatttacagggcactgttgcagacccacttcagctggaagctaggaacatggacaaggagcctctctaccaccaagggagagagaggaatgtgctcttgtcctggcattgcatccacaggaggggcaggaaattctttgaaggtcccgcatctggggctcgatctcgtgcagaggagcatttccgaagacactggccgctcccacaatggctccgaagaccccagcgaccagcgggttcatgagtttgttggggctgtccactcggtaccagctgcgcagggatgtcaggacaaagaaacaagttgcctggttccagccctgcttcagcacggggcctgtggggccccggtaagtcccggtgttcccgcacaatctcctaaccctgtggaagaatcccctgtacttggatttggagaggtctggccatggattaacttcaccttgatggtctccatgggacataggaccaccacggcctcggccacgctagctcactggccgcaccgctgcccgccttgctgttcaccagtccctgggcatcccgcatctggttgctgaggaacgcctgacgccgccttgtggatgaagccgcagagcagggagctgaggctgcggcccaggcccaggctgccttggctgcgactgtgtgcctgcaggccccatgcccgg

SEQ ID NO: 275857 - DNA, 703 bp, Homo sapiens
ggcccgttccaatggcaactctgccaaggcgcctatgagagcctcttggcttttacctggtctgcgagaaatcaaactttgggcacaagtcatgaagccgacaagcccgggagacacagtgtcagaattacaaggtgagatcagccgcccggccaagctatcttctcgctagcaggtcccgcatctggggctcgatctcgtgcagaggagcatttccgaagacactggccgctcccacaatggctccgaagaccccagcgaccagcgggttcatgagtttgttggggctgtccactcggtaccagctgcgcagggatgtcaggacaaagaaacaagttgcctggttccagccctgcttcagcacggggcctgtggggccccggtaagtcccggtgttcccgcacaatctcctaaccctgtggaagaatcccctgtacttggatttggagaggtctggccatggattaacttcaccttgatggtctccatgggacataggaccaccacggcctcggccacgctagctcactggccgcaccgctgcccgccttgctgttcaccagtccctgggcatcccgcatctggttgctgaggaacgcctgacgccgccttgtggatgaagccgcagagcagggagctgaggctgcggcccaggcccaggctgccttggctgcgactgtgtgcctgcaggccccatgcccgg

SEQ ID NO: 275858 - DNA, 529 bp, Homo sapiens
ggaccctcttaattctgccatcagtgcagctcttccagatagagctttggagccaaacccttctgatgatccaagggcaagcacagtcttcttgcaaaaatctcaaacagatggtgagacgacactgttttttccaccaagaagacgactgaaaactctctgtcataatgagtgtattatagaaagcatttagagaaacttacattggtttaaaattttcaacttttcatatattcacttgtcctattttaatgtgtgaaatacttctctttagttgttactgtgtgagtgaaaacatgtaaactttctgtttatacattttgctaccttttggcaacaccatttgtcatgtgatttaagagtagtcatagatttatctttattcataattttttattcatattttttgtctttcgccctttttcccttgctccaaagagttcattttaatgatgaatgatagaatttaggcttcagcttgatctttatttaaacaaataaaaaaaccatttgttcatcaatggggatt

SEQ ID NO: 275859 - DNA, 895 bp, Homo sapiens
agaccacagggaagacatggcacaatgggacagatggatgtgatggccacaatgcacagaccaggccacagagctcgagggatatgggaaggggccttttggcatttctgcactggaatcatgtgagacaagggtggccgggtgctctggaggtgctggggtggtcccctcacggcccctctgagcttactctgtcttccacactttgttgagcagcttcctcacctcatcatagatgataaacactatggccacatgcaggcagacccggcccaggcaggcaatagtgcccttgtagaaggtcttgtgcccttccctcaggatttgcagccacagtcccatgtgttctgcatttgtgcacctccaggtcccgcatctggggctcgatctcgtgcagaggagcatttccgaagacactggccgctcccacaatggctccgaagaccccagcgaccagcgggttcatgagtttgttggggctgtccactcggtaccagctgcgcagggatgtcaggacaaagaaacaagttgcctggttccagccctgcttcagcacggggcctgtggggccccggtaagtcccggtgttcccgcacaatctcctaaccctgtggaagaatcccctgtacttggatttggagaggtctggccatggattaacttcaccttgatggtctccatgggacataggaccaccacggcctcggccacgctagctcactggccgcaccgctgcccgccttgctgttcaccagtccctgggcatcccgcatctggttgctgaggaacgcctgacgccgccttgtggatgaagccgcagagcagggagctgaggctgcggcccaggcccaggctgccttggctgcgactgtgtgcctgcaggccccatgcccgg

SEQ ID NO: 275860 - DNA, 1126 bp, Homo sapiens
ggcccgttccaatggcaactctgccaaggcgcctatgagagcctcttggcttttacctggtctgcgagaaatcaaactttgggcacaagtcatgaagccgacaagcccgggagacacagtgtcagaattacaaggtgagatcagccgcccggccaagctatcttctcgctagcaggaacactacaaggcctgttagagaagaaagggtagaatcccgagaatgttttccccacagtgctgataaggagagaccactatcccatctactgctacagctctggagacagagctctcccacctgtcatatagaacacaaggaccaatctgcagagaaagagcatccaaacctgatccagtggacactggggaaaaactcaccacagctgagtgtggaaaaacaaggccaacacacacatctctgcacagatacatctcccataaagaaactaaagtgttaatttacagggcactgttgcagacccacttcagctggaagctaggaacatggacaaggagcctctctaccaccaagggagagagaggaatgtgctcttgtcctggcattgcatccacaggaggggcaggaaattctttgaaggtcccgcatctggggctcgatctcgtgcagaggagcatttccgaagacactggccgctcccacaatggctccgaagaccccagcgaccagcgggttcatgagtttgttggggctgtccactcggtaccagctgcgcagggatgtcaggacaaagaaacaagttgcctggttccagccctgcttcagcacggggcctgtggggccccggtaagtcccggtgttcccgcacaatctcctaaccctgtggaagaatcccctgtacttggatttggagaggtctggccatggattaacttcaccttgatggtctccatgggacataggaccaccacggcctcggccacgctagctcactggccgcaccgctgcccgccttgctgttcaccagtccctgggcatcccgcatctggttgctgaggaacgcctgacgccgccttgtggatgaagccgcagagcagggagctgaggctgcggcccaggcccaggctgccttggctgcgactgtgtgcctgcaggccccatgcccgg

SEQ ID NO: 275861 - DNA, 938 bp, Homo sapiens
ggcccgttccaatggcaactctgccaaggcgcctatgagagcctcttggcttttacctggtctgcgagaaatcaaactttgggcacaagtcatgaagccgacaagcccgggagacacagtgtcagaattacaaggtgagatcagccgcccggccaagctatcttctcgctagcagatgaagctgctttggtggaaggtgctaaaaagctgggctttgtacagtgagaacaccatattcggtcatcatagaagcaatagagctttggagccaaacccttctgatgatccaagggcaagcacagtcttcttgcaaaaatctcaaacagatggtatctactaagcattttactaaaaagtacagctcgtgttcaaccatatacctagatgacagcacagccagccagcctcatcttacaatcatagtaaaatcgaatgagcttgaaagacagtttttgcagctaattgactataacgtcgaagtttctggaagtgtttatgccaagtactattttgatcttcgatccttggcaaaggacaatagcttgcattttccagtttatcttctcaacaaagaaagggcacagaacctggaagctatttcaaggatggaagacgccaaaatcttttatagtgaaggtccttcagcgctgataatttcattaatcttcagcgctctaaagccattaactcttgaaggaagaaatgaggggctatatcatgtgaacccctcatcaaaaaagttcggaaaatattacctctcatgctcaacaactagaaaagttagtattttcaaaagaagaaaaatctcaaagttgagaggcttgtgggcaactaggattgcactccacaggaaaaaaatgggatcgttgcagtgcaacaactctcgtacactcttctgtctttttaaacgtaaacaggtataaaaactactccaaagt

SEQ ID NO: 275862 - DNA, 175 bp, Homo sapiens
gaaatactatcttcacaatttgaaagtctcagtattctaaacatatagcctgactgaaagaaatgttctgtcccgctgggcgtgttgcctcacgcctgtaatcctagcacttttggaggccaaggcggacggatcacctgaggtcgggagttcgagaccagcctgaccaacacag

SEQ ID NO: 275863 - DNA, 290 bp, Homo sapiens
agactgataataaaggtggatgcgaccatggattctacataatggggattgctgaagtaatattccactggtttggatgttccaatactttgtctagcctggacaacaaagcaagactctgtcccaaaaaaacatttttaaaaattttttgcatacatatagtaaagtgtactctttatgatgtttagttctatgggttttgacagatgcatagagtcagatatataccccacagtaccatactgaacagttctatcaccctaaaaaatcccttatagtggcccctttgt

SEQ ID NO: 275864 - DNA, 134 bp, Homo sapiens
cacacagttatttagaatatagaccaacaagatatttttcagggaggaatactttatcacaatattgttcagaattaccagcacatggtgataataaaaaaacttggctttttattgttgtaaaatgtacataa

SEQ ID NO: 275865 - DNA, 377 bp, Homo sapiens
agttgtcaaggatgaagccccactttctggcttgaagtataggtggtgctattcctagaggaagaccagaggagagaagcaacaggcttagccctatcaagattggcatgcctatgggatatcagagtggagatgtggagtaggatgttggatccatggatgtatagctcaggagaaagttcaaaaatggagatacagatttgataaccatggttatgggtaagatcaccgagagagtgtatagaagacaggaggacctacaatagcaccaaaaaacacaaacaagaaagaagcagaggaagacaatgccacaaaagagactacggagggaaaaacagtaggagaaaaaattagaaagtgggccgggtgcgatggct

SEQ ID NO: 275866 - DNA, 432 bp, Homo sapiens
tgtgccctaaacgaagggggcctcaagttacgacttctcaaggcagtgacatcttcctcaattggtatgagtagctgccaggcaacaagtacgtataagagtgtcccatattctggctgctgtgatggctcatgcctgtagtcccagctacttgggagcctgaggcaggaggtttgcttgagcccaggagtttgaggctgcagtgagctatgatcccaccactgcactccagcctgtgcaacagagtgagaccctgtctcttaaaaatatataaaaataaacaagtcccaaattctcaaaatcactggatcacatcagtcctttttatactctgtatttgtgtgggagtaaaaatatgagatcatgttgggatgttcacatcgtaagcaagactgaattgtcaagtagattgcggctcactcatttatttct

SEQ ID NO: 275867 - DNA, 517 bp, Homo sapiens
cgatatccaggggaaaagctttccaaataaaggaaatagatgtccaacaactctgagatgagatcaatactggtatattcagggagcagcaagaggcccatgtggccagtacactatgaagagtattaggagataaaaagaggaaaatagagaatcatcagggaactggattatggagcaccttggaggttatgagaaaccatgaaggctttgagctttggcatgacaggataacttacatttttattttttttttagaatgacacaacctactagaatgaaaatagagtgaaggtaggctagtcctgaaataaggaaactgattagaaggcattgcaataatcaaggataaagatggtgccttggaccagggcagtggtggtggtgacaggtaatcaaagattgggtctaatttgaagaaacctcaatcaaatcctactgaagttaattagatttgcaagactattgtgtttttgagagaatgagaaaaatcacatagcttcagtctcttcacctt

SEQ ID NO: 275868 - DNA, 501 bp, Homo sapiens
gctgaaagtcaactgataatatatgcaaggctttgtttctgggctctctattgtattacattttatttcctgtcatgccagtatcacattgttttttattgtagctttgtattaagttttgaaatcaggaagtgtgagtcctccaactttgttctttttcaagattgttttggctatttggggtcacttgccattccatatgaagttcaggatagtcctttttttctttttttctttgaagcaggatctcactctgtcacccaggctggagtgccatggcacaaactcagctcactgcagcttcgacctcatgggctcaagcgacccttccatctcagcttcctgagtagctgggactacaggttcgtggcaccacgcccagttaagggtttttctatatgtacaaaaaacaccattaagattttgataggtattgaatctgtagataactttgggtagtattgtcaccttaacaatatgaagtcttcccatccatgaaca

SEQ ID NO: 275869 - DNA, 3313 bp, Homo sapiens
accggggggcggggggccggggtgagcgctaagatggccgccccggctcgggctgttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacgcaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaattttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctactttggtcactaatagtctttcatttgtatattgaagttaccttgccccttggagttattgaagtgacatgtcaaggtatcacctaaatattcttcagtcacactcactggtatttctgaggctttgtgtgttaacaggccttgtaattgacattattttggttaatgtaaccccaaaattgctttagtaattgctctttggcatagtcaaactataaatgaaaatggcagctttacaaatagtatatttaagtgaactctggaactatggacatgaaaaaaatgatggctgggatttatgatttttgtctggcagcaaacaggtttgtccagaagtctaataattaagcagtcataaaaagtctgaatttagtaaaccagtgtatgatgttattcaaatagtttaccttgggtatgagttcattttataatgtctgatgacattagatctcttaaaactttatgtattttttttagttcaaaggaatagagtcttgaagagaaaaaattatagggcagaaaagataagtgttcaaaattggcaactggactattattatgtctagcatctcattctaaataactaaagcttgatttactcttgctaggattatgtgactactaggtaggagcctcttaaaacactggccctgagcattaaaaaaaa

SEQ ID NO: 275870 - DNA, 410 bp, Homo sapiens
tactactactaaattcgcggccgcgtcgacggctgggatttatgatttttgtctggcagcaaacaggtttgtccagaagtctaataattaagcagtcataaaaagtctgaatttagtaaaccagtgtatgatgttattcaaatagtttaccttgggtatgagttcattttataatgtctgatgacattagatctcttaaaactttatgtattttttttagttcaaaggaatagagtcttgaagagaaaaaattatagggcagaaaagataagtgttcaaaattggcaactggactattattatgtctagcatctcattctaaataactaaagcttgatttactcttgctaggattatgtgactactaggtaggagcctcttaaaacactggccctgagcattaaaaaaaa

SEQ ID NO: 275871 - DNA, 3367 bp, Homo sapiens
accggggggcggggggccggggtgagcgctaagatggccgccccggctcgggctgccaactgtcaagtctgttcggcctcagagtatgttatagagccatgaattaaagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacgcaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaattttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctactttggtcactaatagtctttcatttgtatattgaagttaccttgccccttggagttattgaagtgacatgtcaaggtatcacctaaatattcttcagtcacactcactggtatttctgaggctttgtgtgttaacaggccttgtaattgacattattttggttaatgtaaccccaaaattgctttagtaattgctctttggcatagtcaaactataaatgaaaatggcagctttacaaatagtatatttaagtgaactctggaactatggacatgaaaaaaatgatggctgggatttatgatttttgtctggcagcaaacaggtttgtccagaagtctaataattaagcagtcataaaaagtctgaatttagtaaaccagtgtatgatgttattcaaatagtttaccttgggtatgagttcattttataatgtctgatgacattagatctcttaaaactttatgtattttttttagttcaaaggaatagagtcttgaagagaaaaaattatagggcagaaaagataagtgttcaaaattggcaactggactattattatgtctagcatctcattctaaataactaaagcttgatttactcttgctaggattatgtgactactaggtaggagcctcttaaaacactggccctgagcattaaaaaaaa

SEQ ID NO: 275872 - DNA, 1840 bp, Homo sapiens
caggctgtacgcccggagtacgggatcaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaattttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctactttggtcactaatagtctttcatttgtatattgaagttaccttgccccttggagttattgaagtgacatgtcaaggtatcacctaaatattcttcagtcacactcactggtatttctgaggctttgtgtgttaacaggccttgtaattgacattattttggttaatgtaaccccaaaattgctttagtaattgctctttggcatagtcaaactataaatgaaaatggcagctttacaaatagtatatttaagtgaactctggaactatggacatgaaaaaaatgatggctgggatttatgatttttgtctggcagcaaacaggtttgtccagaagtctaataattaagcagtcataaaaagtctgaatttagtaaaccagtgtatgatgttattcaaatagtttaccttgggtatgagttcattttataatgtctgatgacattagatctcttaaaactttatgtattttttttagttcaaaggaatagagtcttgaagagaaaaaattatagggcagaaaagataagtgttcaaaattggcaactggactattattatgtctagcatctcattctaaataactaaagcttgatttactcttgctaggattatgtgactactaggtaggagcctcttaaaacactggccctgagcattaaaaaaaa

SEQ ID NO: 275873 - DNA, 1629 bp, Homo sapiens
  misc_feature (282)..(282): n is a, c, g, or t
  misc_feature (290)..(290): n is a, c, g, or t
agtaatcaagactgtggttctgacataaggaaggacatagacaatacaattgaggatccaaaaataaatccacacatttacaggcaactgatttttagcaagggtgccaagacattcagtggggagagaaccatcttgtcaacaaatggtgcagggacaattggatatccacaggtaaaagaattaatttggacccctatctcaggcattatacagaaactaacctaaacaaatcaaataccaaacaataatctgaaactataaaactcttagacacataantaaaaatnttctgacattggattaggcaatggtgtgatacctgaagtacaagcaacaagagaaaaaaatagataaaattgaacttaatattaaacttggcctggtgccgaattcggcacgagccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaattttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctactttggtcactaatagtctttcatttgtatattgaagttaccttgccccttggagttattgaagtgacatgtcaaggtatcacctaaatattcttcagtcacactcactggtatttctgaggctttgtgtgttaacaggccttgtaattgacattattttggttaatgtaaccccaaaattgctttagtaattgctctttggcatagtcaaactataaatgaaaatggcagctttacaaatagtatatttaagtgaactctggaactatggacatgaaaaaaatgatggctgggatttatgatttttgtctggcagcaaacaggtttgtccagaagtctaataattaagcagtcataaaaagtctgaatttagtaaaccagtgtatgatgttattcaaatagtttaccttgggtatgagttcattttataatgtctgatgacattagatctcttaaaactttatgtattttttttagttcaaaggaatagagtcttgaagagaaaaaattatagggcagaaaagataagtgttcaaaattggcaactggactattattatgtctagcatctcattctaaataactaaagcttgatttactcttgctaggattatgtgactactaggtaggagcctcttaaaacactggccctgagcattaaaaaaaa

SEQ ID NO: 275874 - DNA, 2817 bp, Homo sapiens
agcggggggacttcaggaaagcagtttccaggaggtgagagtttaagccaaacctgaaagaggttgatttgtaatgatttgcaggggggcactggaggcagccgccaggacttttcacttaggagatcagcatttgccctgatggaaactgggcgatcctgcagggactgacctctgagttatccaaaggccgacctggggaaagactgattttgaggttttaatagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacgcaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaattttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactct

SEQ ID NO: 275875 - DNA, 3520 bp, Homo sapiens
cggggcacttcgggagggcggttgtggcactcggttgaggaggaatgcgcttcccggcgtcttgcccgccttctctccatcgatcggtccccgcgctgccggcacctgctgccgcttaaagcttgaaaatcagcttcctaaagccattcccgatggccttcgatgggaaagaatgccatatggctgaattcattatgggggataagaaatatgtcagtgtgcgcggaggggaacctgttaatacgttcaaatttaagagtagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacgcaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggaaaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaattttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctactttggtcactaatagtctttcatttgtatattgaagttaccttgccccttggagttattgaagtgacatgtcaaggtatcacctaaatattcttcagtcacactcactggtatttctgaggctttgtgtgttaacaggccttgtaattgacattattttggttaatgtaaccccaaaattgctttagtaattgctctttggcatagtcaaactataaatgaaaatggcagctttacaaatagtatatttaagtgaactctggaactatggacatgaaaaaaatgatggctgggatttatgatttttgtctggcagcaaacaggtttgtccagaagtctaataattaagcagtcataaaaagtctgaatttagtaaaccagtgtatgatgttattcaaatagtttaccttgggtatgagttcattttataatgtctgatgacattagatctcttaaaactttatgtattttttttagttcaaaggaatagagtcttgaagagaaaaaattatagggcagaaaagataagtgttcaaaattggcaactggactattattatgtctagcatctcattctaaataactaaagcttgatttactcttgctaggattatgtgactactaggtaggagcctcttaaaacactggccctgagcattaaaaaaaa

SEQ ID NO: 275876 - DNA, 574 bp, Homo sapiens
cacccaactatctataaactagccatggccatccccttatgagcgggcgcagtgattataggctttcgctctaagattaaaaatgccctagcccacttcttaccacaaggcacacacacatatatatcttcaaaaattctatttttcagtgtaatctagaccttaatacctggttattgacctgaagatatatactttctaccagcaggttacagattcaaaatgaaacctgaaaagtatttaaactgataatgtgatattaataacattaaagtttatgtgttatctaaattagatatgattgggcacagtggtcaaaatatactgcaaaatttaggtttatggtcaccttttttggaatcagggttgtttgctcttatatctgactgtttgacatttgttctcaattctccatctcagaagaaggcttttttcttttttgatttgtataaattttaggggtatgagtatagttttgttacatggctatattatgtaggtagtgaagtctgggcttttagtgtatccatcaccggaataatgtacattatattcattgaggtaattttttttt

SEQ ID NO: 275877 - DNA, 409 bp, Homo sapiens
ataagtcattctcaaaactcaacctctgtttaacctttaaaagagcatttgagaaagaataataagacgtaattctgccaaggtgcggcctgaccctgagtaaatcattcaacttctgttggatgatttcctcatgtgaaagatgaacagtattgtgctggaagctaaggttccctcctactctaaatgtttaaaattctgtatcagtggactgtgaaaggaaaaatagatggataataccagagttggaaagtgtgagagtttatctgtttacattaaaaacaactataatgatgcagcaacctgtgatgatacccaacggaacaatgcaaaaaaatgtcagttttataatatgtatgtatttctttagccacacaaaataaaattttgtttctagtccttattaaga

SEQ ID NO: 275878 - DNA, 336 bp, Homo sapiens
gagtgctagtgctggtctagacaaagatgtcaagtggcagatgacacctcaaaaagcctattagcaaagtactacactgtgcttacctttcaagaatgatttcctcatgggtgactttgttccacatttttggatttctccatataactgattttaatcatcctgatgaaaatatatctaaactttaatgaatactttcctgcctaccttttagatagtcactgaacagaattccaacagattttcatgaatatcagttattgttataatgtagtggtcccctctgggattcccaagatgggatgaactatttcggacatggcagaagtgtttctc

SEQ ID NO: 275879 - DNA, 758 bp, Homo sapiens
cagcaggtcggggctgggcatgagattgttcacttctgacaagctcccaaatgatgctattataacaccggtcatctaggaactacttcggtaactaggcgatagaccacttccaagtcagaggagaaggcctggagaagccttctctgtggtccagcctcatagaacggcaatcctagggtcagagtgccctacaagctacaggagccccaaggaggaggatagtggcttagaagagaggtgctctcctggaggtatacaccaatttaacaagtgggcgtctcccagtaaaaattttcttaggggaaaggggggagtcaagctgtaggtgttggctccctaaaacaactcaccacctcagaattagctcccaggagcagaaaccaacgtcctgctgccacacttctctagactcaatcagctctgccccacccactccacaaaagctctctgccgcgtcttcctctaggggagaggtgactgcaggctgggagactccccagctgtgactcagaccgacggaatcaaatctgttcccccaggctcagcattcaccagatcctgacctccccctctgaccagccccaacccacctttccaagccccacctctcagtccatgggccacccctcgcccaccccacttccctgtctctggctcatcttcagatgtgtccctagctcccaacccgtccaagcgcagccgagtttctcggtccacatcgcctcgatattcccacagcatctgtggtctctctt

SEQ ID NO: 275880 - DNA, 411 bp, Homo sapiens
aaaaataaataaataaataaaatgattttgaggccactgagaaaagtggggcccctagtaatttgtaacagcctcccactccctatcaagaggaggtggtagaccgagattctaaattgaaaaatgaaggccgggtgcggtggctcacgcctgtaatcccagtgctttgggaggccgaggcgggtggatcacaaaatcaggagatcgagaccatcctggctaacacggtgaaaccctgtctctactaaaaatacgaaaaattagctgggcgtggtggcgggcgcctgtagtcccagctactcgggaggctgaggcaggagaatggtgtgaacccgggaggcggagcatgcagtgagccgagatcgcaccactgcactccagcctgagcgacagagcaagactctgtctcaa

SEQ ID NO: 275881 - DNA, 1737 bp, Homo sapiens
acacacacccctgattccagaaacacaacaggagctgactcaaaagggagtgtctggtgcaggcatgcagggaggaagaatgactctgagcttgaccattcaacttcgaaactttaacatcaatggatcagcacacactggtgtacggtctgctatgcatgcagccctgtgctaggcaaaagaagtatcagaccaggaactgacagcctcactgcaacaggaagagaggcttcacacaataagcgtttcattcaaccaggctggacctgtgcttattgagttgaacatcactgagcacaaaatgcaagccagacaccataagagctgtaaggatgataaagatgtctttctaccctcgagagctctaagtgtggtcaggagagaaacacatgcaaagattatgctggctggaaggaaatgctggaatgaaggtggaagcattctattcatctaaaagcaccggtaattaacgatgctaataaatgtataatccctttgtaaacatctcttcacaaggtcataaagaaggaagactgaatgaaggacgccaggctttcattttagaattaattttgtcattgaatgcactcactgcattatttgatagagtacttttgcatttgaagtagtacatttgccttctaccatctcattaacattgctttcaacagaatcagaaataacacaaaccactgcagggtaattttgaatgctcatttgactatgcagtgacatcaagtggcgagttgaggaatgatcatatgctgtgtgagaactccgtgtcaaaaattccatggagccaggctagacaccacatttggcactttcagctgtttagatttcagagaattaaaaggaaatggtcaccgacctgcctttgatagtacccgtataccccttcccaccataagaaaccagcgttccttagagaaatggctaattctagctctagggcaagaaatgctaagatgtgctcaaaacatctcattataccagcaagccagggagccatcaacgactactggagctgtgtcaaaaggaccaacaaaccaacttgaagaggctcccgctggccaacagtggggcaattagagcatcaataagaataatatctgtaacaaactgaaacgtatcaaatatgtttaaattcatatgtttataattacactcaaaaaacgaagatgcagaccactttaccttgaggatgttacagaatgaaattatcattctgaaaactggtaaataaagagaaggtatcaagtaagcatgtatctggctttttctatatgaaataaaggaagccaaatagtaaacgaggggaagtttctctttactgaaatattgcaggtaattaaagaagaaggagaaacagagaacattatcgttttatggcctctaatggaacaagacatctaggcaatgatgaactatggtcaccaacatcactcaatcagggacaatcagacactgtgggcccctgaaggaagtaaacaccaccacgtaggaaatattctcaccaaaacttcaaaaacttgaatctgatctagtctttagtttcaactactaatttacaggcaatacggggctcagagggatgtggtaaaatgtcacggaaatataatcagcaaaatccagtacagataataagaagacaaatgatccacagatggaaaggaagaatgtaaagttgtgttggtaaagaaattcacagattaataaaagcttaaaaatgtacca

SEQ ID NO: 275882 - DNA, 765 bp, Homo sapiens
gcacgaggctctgtcgcccaggctggagtgcagtggcgcgatctcggctcactgcatcctccgtttcctgggttcaagtgattctcctgccttggcctcccgagtagctgggattacaggtgcatgccaccacgcccggctagttttttatatttttggtagagacggggttttaccatgttggccaggcttgtcttgaactcttgacctcaagtaatctgcctgcctctgcctcccaaagggctgggattacaggtgtgagccaccacacccagcccctgaatatatgtatttcgacagaggactgctgaagaccccaaaccagtgtctggtttcaaggtgcttgtgatctggctctccctttcttacccacctgtacttccttcacatctccaggctctatggtttagcctccttggttttcccactggctcacaaaaaaaataagttcccaagtgctcacctctgtccctgtccgaaactgccttgtgcttgattcccatttatcctatttttgacccaaattcattccctccctgtaggattttcttcaccttatctcctctatgactcttcctgccttccctcatcattctagacctcgctgatcaccttccaccaggaactatacaagacttggggtctgttctgttcaaaattacagaaaccctattttctgcctattagttaacttatgaatacatattaagtaataatgaattgaaataaatgaataataaatgtctcaatttctgttatatgaat

SEQ ID NO: 275883 - DNA, 618 bp, Homo sapiens
caggtgaccatcaggtgatggtcaggcggctgttagtctgtcgctctaaaataataattggtcgcagccggtgctagggaaagacaggctcccagtagatagaaaacacctgaaacgggtgataagcagcttcccggtaagatcttagcagttgggcgagtgtactcaagcatgagcactaacaggcagaatgccagagtttaactggtatatgaccttctagggacattcgactgataagggaagaacgcctcacgtgagcatgtgtacaactcctgcatgcgtacaaacacactgcgcatgctcccctcccaggcgctggcaggccacacactgcgcatgctcccctcccaggtgctggcaggccacacactgcgcatgctcccctcccaggtgctggcaggccactgcgcaagtgtggacagcctacaccaagggaagagtcaggggagaaggaacacaagactccggaagcatgccagcgtataaaaccgtaagtcaaaggtcagactgtccagtgggtgatctctcaagtcgcccgcttggcctcttccaagtgtactttacttcctttcattcctgctctaaaactttttaataaactttcattcctgctct

SEQ ID NO: 275884 - DNA, 2252 bp, Homo sapiens
tagagatgttgtgcaaacagcaggccagaagcttgctccttagaatcctaatatctaaatggtgggtgaagaaagaggaccggtcaaaggacagtgagaaggggctgagaagcagaaggaaacccagcagagagtgagatggagaatgtcatcactcagggagtcctaaaattcactccgggaaaacccccaattctttacatttattcccaggcagactgaaatgctggtaatgcagataaaattttccctattgcttcatcgtagaatccttttactggaaaacaaacaaactgggtgggctatgggaacagatacatgagttctcctctctgctaatttaaccaaccacactgactcccatcacagaactgcacaaacaagccagaaactgaaccctacccggaatcccctggtgtatgaagggagcctagctctggctgactctgcttgtgttcacagacactttgcctcattggttcgtgcctcagcttccaatctggacatggagcacaataacagtgggcccactgctctccgaattcctgcgcgcacttgaagggagtgtctggtgcaggcatgcagggaggaagaatgactctgagcttgaccattcaacttcgaaactttaacatcaatggatcagcacacactggtgtacggtctgctatgcatgcagccctgtgctaggcaaaagaagtatcagaccaggaactgacagcctcactgcaacaggaagagaggcttcacacaataagcgtttcattcaaccaggctggacctgtgcttattgagttgaacatcactgagcacaaaatgcaagccagacaccataagagctgtaaggatgataaagatgtctttctaccctcgagagctctaagtgtggtcaggagagaaacacatgcaaagattatgctggctggaaggaaatgctggaatgaaggtggaagcattctattcatctaaaagcaccggtaattaacgatgctaataaatgtataatccctttgtaaacatctcttcacaaggtcataaagaaggaagactgaatgaaggacgccaggctttcattttagaattaattttgtcattgaatgcactcactgcattatttgatagagtacttttgcatttgaagtagtacatttgccttctaccatctcattaacattgctttcaacagaatcagaaataacacaaaccactgcagggtaattttgaatgctcatttgactatgcagtgacatcaagtggcgagttgaggaatgatcatatgctgtgtgagaactccgtgtcaaaaattccatggagccaggctagacaccacatttggcactttcagctgtttagatttcagagaattaaaaggaaatggtcaccgacctgcctttgatagtacccgtataccccttcccaccataagaaaccagcgttccttagagaaatggctaattctagctctagggcaagaaatgctaagatgtgctcaaaacatctcattataccagcaagccagggagccatcaacgactactggagctgtgtcaaaaggaccaacaaaccaacttgaagaggctcccgctggccaacagtggggcaattagagcatcaataagaataatatctgtaacaaactgaaacgtatcaaatatgtttaaattcatatgtttataattacactcaaaaaacgaagatgcagaccactttaccttgaggatgttacagaatgaaattatcattctgaaaactggtaaataaagagaaggtatcaagtaagcatgtatctggctttttctatatgaaataaaggaagccaaatagtaaacgaggggaagtttctctttactgaaatattgcaggtaattaaagaagaaggagaaacagagaacattatcgttttatggcctctaatggaacaagacatctaggcaatgatgaactatggtcaccaacatcactcaatcagggacaatcagacactgtgggcccctgaaggaagtaaacaccaccacgtaggaaatattctcaccaaaacttcaaaaacttgaatctgatctagtctttagtttcaactactaatttacaggcaatacggggctcagagggatgtggtaaaatgtcacggaaatataatcagcaaaatccagtacagataataagaagacaaatgatccacagatggaaaggaagaatgtaaagttgtgttggtaaagaaattcacagattaataaaagcttaaaaatgtacca

SEQ ID NO: 275885 - DNA, 1128 bp, Homo sapiens
tagagatgttgtgcaaacagcaggccagaagcttgctccttagaatcctaatatctaaatggtgggtgaagaaagaggaccggtcaaaggacagtgagaaggggctgagaagcagaaggaaacccagcagagagtgagatggagaatgtcatcactcagggagtcctaaaattcactccgggaaaacccccaattctttacatttattcccaggcagactgaaatgctggtaatgcagataaaattttccctattgcttcatcgtagaatccttttactggaaaacaaacaaactgggtgggctatgggaacagatacatgagttctcctctctgctaatttaaccaaccacactgactcccatcacagaactgcacaaacaagccagaaactgaaccctacccggaatcccctggtgtatgaagggagcctagctctggctgactctgcttgtgttcacagacactttgcctcattggttcgtgcctcagcttccaatctggacatggagcacaataacagtgggcccactgctctccgaattcctgcgcgcacttgaagggagtgtctggtgcaggcatgcagggaggaagaatgactctgagcttgaccattcaacttcgaaactttaacatcaatggatcagcacacactggtgtacggtctgctatgcatgcagccctgtgctaggcaaaagaagtatcagaccaggaactgacagcctcactgcaacaggaagagaggcttcacacaataagcgtttcattcaaccaggctggacctgtgcttattgagttgaacatcactgagcacaaaatgcaagccagacaccataagagctgtaaggatgataaagatgtctttctaccctcgagagctctaagtgtggtcaggagagaaacacatgcaaagattatgctggctggaaggaaatgctggaatgaaggtggaaggtacatccagaatgttctgggggtgaggaatagcgaatgatgggttctgacttagaacatgaagggaaggtattaagaaagaggtgatattaagcatttattgagcatctctactttttttgtgtatgtgaccttgtttggaaatacaatatctcttcttgatgctggcaaaaaa

SEQ ID NO: 275886 - DNA, 2364 bp, Homo sapiens
caggtgaccatcaggtgatggtcaggcggctgttagtctgtcgctctaaaataataattggtcgcagccggtgctagggaaagacaggctcccagtagatagaaaacacctgaaacgggtgataagcagcttcccggtaagatcttagcagttgggcgagtgtactcaagcatgagcactaacaggcagaatgccagagtttaactggtatatgaccttctagggacattcgactgataagggaagaacgcctcacgtgagcatgtgtacaactcctgcatgcgtacaaacacactgcgcatgctcccctcccaggcgctggcaggccacacactgcgcatgctcccctcccaggtgctggcaggccacacactgcgcatgctcccctcccaggtgctggcaggccactgcgcaagtgtggacagcctacaccaagggaagagtcaggggagaaggaacacaagactccggaagcatgccagcgtataaaaccacttgggacagaactggagtcagagataccaatttgggaaggagaaggatctagtgacagaaacttgggagtgcccagtggacactttgcctcattggttcgtgcctcagcttccaatctggacatggagcacaataacagtgggcccactgctctccgaattcctgcgcgcacttgaagggagtgtctggtgcaggcatgcagggaggaagaatgactctgagcttgaccattcaacttcgaaactttaacatcaatggatcagcacacactggtgtacggtctgctatgcatgcagccctgtgctaggcaaaagaagtatcagaccaggaactgacagcctcactgcaacaggaagagaggcttcacacaataagcgtttcattcaaccaggctggacctgtgcttattgagttgaacatcactgagcacaaaatgcaagccagacaccataagagctgtaaggatgataaagatgtctttctaccctcgagagctctaagtgtggtcaggagagaaacacatgcaaagattatgctggctggaaggaaatgctggaatgaaggtggaagcattctattcatctaaaagcaccggtaattaacgatgctaataaatgtataatccctttgtaaacatctcttcacaaggtcataaagaaggaagactgaatgaaggacgccaggctttcattttagaattaattttgtcattgaatgcactcactgcattatttgatagagtacttttgcatttgaagtagtacatttgccttctaccatctcattaacattgctttcaacagaatcagaaataacacaaaccactgcagggtaattttgaatgctcatttgactatgcagtgacatcaagtggcgagttgaggaatgatcatatgctgtgtgagaactccgtgtcaaaaattccatggagccaggctagacaccacatttggcactttcagctgtttagatttcagagaattaaaaggaaatggtcaccgacctgcctttgatagtacccgtataccccttcccaccataagaaaccagcgttccttagagaaatggctaattctagctctagggcaagaaatgctaagatgtgctcaaaacatctcattataccagcaagccagggagccatcaacgactactggagctgtgtcaaaaggaccaacaaaccaacttgaagaggctcccgctggccaacagtggggcaattagagcatcaataagaataatatctgtaacaaactgaaacgtatcaaatatgtttaaattcatatgtttataattacactcaaaaaacgaagatgcagaccactttaccttgaggatgttacagaatgaaattatcattctgaaaactggtaaataaagagaaggtatcaagtaagcatgtatctggctttttctatatgaaataaaggaagccaaatagtaaacgaggggaagtttctctttactgaaatattgcaggtaattaaagaagaaggagaaacagagaacattatcgttttatggcctctaatggaacaagacatctaggcaatgatgaactatggtcaccaacatcactcaatcagggacaatcagacactgtgggcccctgaaggaagtaaacaccaccacgtaggaaatattctcaccaaaacttcaaaaacttgaatctgatctagtctttagtttcaactactaatttacaggcaatacggggctcagagggatgtggtaaaatgtcacggaaatataatcagcaaaatccagtacagataataagaagacaaatgatccacagatggaaaggaagaatgtaaagttgtgttggtaaagaaattcacagattaataaaagcttaaaaatgtacca

SEQ ID NO: 275887 - DNA, 2283 bp, Homo sapiens
caggtgaccatcaggtgatggtcaggcggctgttagtctgtcgctctaaaataataattggtcgcagccggtgctagggaaagacaggctcccagtagatagaaaacacctgaaacgggtgataagcagcttcccggtaagatcttagcagttgggcgagtgtactcaagcatgagcactaacaggcagaatgccagagtttaactggtatatgaccttctagggacattcgactgataagggaagaacgcctcacgtgagcatgtgtacaactcctgcatgcgtacaaacacactgcgcatgctcccctcccaggcgctggcaggccacacactgcgcatgctcccctcccaggtgctggcaggccacacactgcgcatgctcccctcccaggtgctggcaggccactgcgcaagtgtggacagcctacaccaagggaagagtcaggggagaaggaacacaagactccggaagcatgccagcgtataaaaccacactttgcctcattggttcgtgcctcagcttccaatctggacatggagcacaataacagtgggcccactgctctccgaattcctgcgcgcacttgaagggagtgtctggtgcaggcatgcagggaggaagaatgactctgagcttgaccattcaacttcgaaactttaacatcaatggatcagcacacactggtgtacggtctgctatgcatgcagccctgtgctaggcaaaagaagtatcagaccaggaactgacagcctcactgcaacaggaagagaggcttcacacaataagcgtttcattcaaccaggctggacctgtgcttattgagttgaacatcactgagcacaaaatgcaagccagacaccataagagctgtaaggatgataaagatgtctttctaccctcgagagctctaagtgtggtcaggagagaaacacatgcaaagattatgctggctggaaggaaatgctggaatgaaggtggaagcattctattcatctaaaagcaccggtaattaacgatgctaataaatgtataatccctttgtaaacatctcttcacaaggtcataaagaaggaagactgaatgaaggacgccaggctttcattttagaattaattttgtcattgaatgcactcactgcattatttgatagagtacttttgcatttgaagtagtacatttgccttctaccatctcattaacattgctttcaacagaatcagaaataacacaaaccactgcagggtaattttgaatgctcatttgactatgcagtgacatcaagtggcgagttgaggaatgatcatatgctgtgtgagaactccgtgtcaaaaattccatggagccaggctagacaccacatttggcactttcagctgtttagatttcagagaattaaaaggaaatggtcaccgacctgcctttgatagtacccgtataccccttcccaccataagaaaccagcgttccttagagaaatggctaattctagctctagggcaagaaatgctaagatgtgctcaaaacatctcattataccagcaagccagggagccatcaacgactactggagctgtgtcaaaaggaccaacaaaccaacttgaagaggctcccgctggccaacagtggggcaattagagcatcaataagaataatatctgtaacaaactgaaacgtatcaaatatgtttaaattcatatgtttataattacactcaaaaaacgaagatgcagaccactttaccttgaggatgttacagaatgaaattatcattctgaaaactggtaaataaagagaaggtatcaagtaagcatgtatctggctttttctatatgaaataaaggaagccaaatagtaaacgaggggaagtttctctttactgaaatattgcaggtaattaaagaagaaggagaaacagagaacattatcgttttatggcctctaatggaacaagacatctaggcaatgatgaactatggtcaccaacatcactcaatcagggacaatcagacactgtgggcccctgaaggaagtaaacaccaccacgtaggaaatattctcaccaaaacttcaaaaacttgaatctgatctagtctttagtttcaactactaatttacaggcaatacggggctcagagggatgtggtaaaatgtcacggaaatataatcagcaaaatccagtacagataataagaagacaaatgatccacagatggaaaggaagaatgtaaagttgtgttggtaaagaaattcacagattaataaaagcttaaaaatgtacca

SEQ ID NO: 275888 - DNA, 1658 bp, Homo sapiens
caggtgaccatcaggtgatggtcaggcggctgttagtctgtcgctctaaaataataattggtcgcagccggtgctagggaaagacaggctcccagtagatagaaaacacctgaaacgggtgataagcagcttcccggtaagatcttagcagttgggcgagtgtactcaagcatgagcactaacaggcagaatgccagagtttaactggtatatgaccttctagggacattcgactgataagggaagaacgcctcacgtgagcatgtgtacaactcctgcatgcgtacaaacacactgcgcatgctcccctcccaggcgctggcaggccacacactgcgcatgctcccctcccaggtgctggcaggccacacactgcgcatgctcccctcccaggtgctggcaggccactgcgcaagtgtggacagcctacaccaagggaagagtcaggggagaaggaacacaagactccggaagcatgccagcgtataaaaccacactttgcctcattggttcgtgcctcagcttccaatctggacatggagcacaataacagtgggcccactgctctccgaattcctgcgcgcacttgaagaatcagaaataacacaaaccactgcagggtaattttgaatgctcatttgactatgcagtgacatcaagtggcgagttgaggaatgatcatatgctgtgtgagaactccgtgtcaaaaattccatggagccaggctagacaccacatttggcactttcagctgtttagatttcagagaattaaaaggaaatggtcaccgacctgcctttgatagtacccgtataccccttcccaccataagaaaccagcgttccttagagaaatggctaattctagctctagggcaagaaatgctaagatgtgctcaaaacatctcattataccagcaagccagggagccatcaacgactactggagctgtgtcaaaaggaccaacaaaccaacttgaagaggctcccgctggccaacagtggggcaattagagcatcaataagaataatatctgtaacaaactgaaacgtatcaaatatgtttaaattcatatgtttataattacactcaaaaaacgaagatgcagaccactttaccttgaggatgttacagaatgaaattatcattctgaaaactggtaaataaagagaaggtatcaagtaagcatgtatctggctttttctatatgaaataaaggaagccaaatagtaaacgaggggaagtttctctttactgaaatattgcaggtaattaaagaagaaggagaaacagagaacattatcgttttatggcctctaatggaacaagacatctaggcaatgatgaactatggtcaccaacatcactcaatcagggacaatcagacactgtgggcccctgaaggaagtaaacaccaccacgtaggaaatattctcaccaaaacttcaaaaacttgaatctgatctagtctttagtttcaactactaatttacaggcaatacggggctcagagggatgtggtaaaatgtcacggaaatataatcagcaaaatccagtacagataataagaagacaaatgatccacagatggaaaggaagaatgtaaagttgtgttggtaaagaaattcacagattaataaaagcttaaaaatgtacca

SEQ ID NO: 275889 - DNA, 1576 bp, Homo sapiens
caggtgaccatcaggtgatggtcaggcggctgttagtctgtcgctctaaaataataattggtcgcagccggtgctagggaaagacaggctcccagtagatagaaaacacctgaaacgggtgataagcagcttcccggtaagatcttagcagttgggcgagtgtactcaagcatgagcactaacaggcagaatgccagagtttaactggtatatgaccttctagggacattcgactgataagggaagaacgcctcacgtgagcatgtgtacaactcctgcatgcgtacaaacacactgcgcatgctcccctcccaggcgctggcaggccacacactgcgcatgctcccctcccaggtgctggcaggccacacactgcgcatgctcccctcccaggtgctggcaggccactgcgcaagtgtggacagcctacaccaagggaagagtcaggggagaaggaacacaagactccggaagcatgccagcgtataaaaccttctctctctgtgacctgtaatttgagggtgacaaaaaagaacttcccatgaaagaacaaacaaacatgacaccacctgggaccattgaagttggatttcccctggtaaggtctgatgttataccctttaatcatctttgttgggttctgccaagcctccccaaacttcccacacttctcattagtggatcagtgggtatccttgctagagactgaccgattgtgggtacaatggcacggttgttcttgctgaccacacatctgtttatacagtaccatgattgtttcttgagcaaacaaaagcaaagacagtgcaacgaaaacacaaaaagttttatcttctagtaagaactatgagaagtattttcaggaaagattgactctgcaattctgccacaaaactcagtgatgtgattatgcctcaccaacaagcaatggaaaacttttatgggaaaaagtgtgtagtatcaatttccaacttttggtcaactgaactgaaaagaatcaatggatgtatttatctgaacaggatttaatttgaatgcgcaactagccacagattacagctcaaaaaaagtgtatgtacttaaaaggaagcttatgtgaatttttttgagcctggtgaacattatgtgtgctgtacaatatataaaataacatcatcattacatattagaaataaaatgtgagaaatcagatgcctattaagacacaaaaattgatgtaaaactatgatattgggttttggataatagcccagatgtttcagaaaaggaattaatgagttttgacatatttccagataattaaaattagccactatttcccccaggttgttggggtccaagcatccttgttgccatggataatgtattttattccttaacaaagtggagtcaggtggcttgaatcaaaatatgacccagaaattattatgaaaatgtcacataagcaagttactttctttctcctaatgatcacacatctgagtctttactcagaattaggatataatggctcttcctctcgctttttgtaaaccttgaaggattttaaatagtaaatgttttgaaaagttgaaat

SEQ ID NO: 275890 - DNA, 1124 bp, Homo sapiens
caggtgaccatcaggtgatggtcaggcggctgttagtctgtcgctctaaaataataattggtcgcagccggtgctagggaaagacaggctcccagtagatagaaaacacctgaaacgggtgataagcagcttcccggtaagatcttagcagttgggcgagtgtactcaagcatgagcactaacaggcagaatgccagagtttaactggtatatgaccttctagggacattcgactgataagggaagaacgcctcacgtgagcatgtgtacaactcctgcatgcgtacaaacacactgcgcatgctcccctcccaggcgctggcaggccacacactgcgcatgctcccctcccaggtgctggcaggccacacactgcgcatgctcccctcccaggtgctggcaggccactgcgcaagtgtggacagcctacaccaagggaagagtcaggggagaaggaacacaagactccggaagcatgccagcgtataaaaccttctctctctgtgacctgtaatttgagggtgacaaaaaagaacttcccatgaaagaacaaacaaacatgacaccacctgggaccattgaagttggatttcccctggtaaggtctgatgttataccctttaatcatctttgttgggttctgccaagcctccccaaacttcccacacttctcattagtggatcagtgggtatccttgctagagactgaccgattgtgggtacaatggcacggttgttcttgctgaccacacatctgtttatacagtaccatgattgtttcttgagcaaacaaaagcaaagacagtgtagagacggggtttcactatgttggccaagctggtctcagactcctgacctcgtgatctgcccgccttggcctcccaaagtgctgggattacaggattttcttcaccttatctcctctatgactcttcctgccttccctcatcattctagacctcgctgatcaccttccaccaggaactatacaagacttggggtctgttctgttcaaaattacagaaaccctattttctgcctattagttaacttatgaatacatattaagtaataatgaattgaaataaatgaataataaatgtctcaatttctgttatatgaat

SEQ ID NO: 275891 - DNA, 164 bp, Homo sapiens
tagagactgaccgattgtgggtacaatggcacggttgttcttgctgaccacacatctgtttatacagtaccatgattgtttcttgagcaaacaaaagcaaagacagtggtaagttgtttccctactatcagctcatgacctaccataacacttaggacgtttca

SEQ ID NO: 275892 - DNA, 302 bp, Homo sapiens
ccttggctaactacagtttttcacatggaaatgaaacttacagtacacacttaacgtatcacagaatttttttctggatttcctgtcctgaagcatgaagtgtactagaaaccaattcttcctgcgctacttgtggaatctttcttactggatcataatcttactttactttatacaatagatgcttaatcagtgcctttaataggaagttggaaactccaaatccaatcaacaaggctttgattctgcctcctaagtactacccagatcacagacaatccaaatatcagaactaggggtct

SEQ ID NO: 275893 - DNA, 189 bp, Homo sapiens
gttgcggtgagccgagatcctgccatcacactccagcctgggcaacaagagcaaaactccatctcaaaaacaaaacaaaatgaacccatcagtctgttaactcatctacagcataaatgtctttactactcgatggttttctactctgtcaacctcatgtctgtccccttctctgggtctacttatttt

SEQ ID NO: 275894 - DNA, 512 bp, Homo sapiens
agatgaaaaatattaaggtagttgaaaagggtcaagtgttatgaaaatgacttggctttgtcttcaggattcttttaattaggacctgtgataagtcatctgaatgtcctttgtaaaatgttaaggaaaagtataatatatatggtcatagtttccatgtgtgtaaagacgcgagactgcttagctttcccagtttgcttccattgttaaaatactgattctgactagagttgaaatcttgatgtgtcctatggattgaatcgtatctcaaggccttggagtagatgagacctttgaaagagcccttgagaagatgataattctcccaagattatctttgaaaatacgtgggtgttatttaagtgaggttgtaatctcgtagagtgtaattgtggagtaaatgaaaattaggctgggcgcaatgctgtagtcccaactacttgggaggttcacttgagccctggagtttgagtccagcctgggcaacatagttaaacccctgtctctttaaa

SEQ ID NO: 275895 - DNA, 655 bp, Homo sapiens
ttcaggatggagagaggttgggagggagggaaagaggtcaaagaggcagagaaaaaagaagaggtagacattgagaatgagtccacaagtacatgagagagaaggatagaaacaaagattctctctgagactacgtgaccacttggagaccctgcccaggcaggaggcaaatgaggtcattaaatccatctgcgcagatgggaggctctctggggaaagttatatgcaaagtgtcatgatgcaatgaggtgaaatctacttgcgttagttcaggtggggactcaagcaggaactgcactgtgctctttggaaagatagattatctcctggatggggaagacactcactctgttgggctcttcctatcagtttgcagaaaggaaagctggccaaggtcacagagcacatgaaggaacgaactggcaactgtattgaactcagttctctcacttgttcgtatgctaaaatctgcttcccaggtccttcaaatttggtgcaaaaccaccatgcgatctattccctactcaggattccaagcctcccagaaggtggtctagcttccctgagacatgctttttgttttcatcattgcctactaaagtcaaagtgaccagtatgtgcagagacttatgttttctcaaaagacacttccaca

SEQ ID NO: 275896 - DNA, 553 bp, Homo sapiens
acaggcatagtttcagttaggtaagaagaataagttctacagatacctgtagaacattatgtagaacaaatgctgtacaacattgtgcctgtaggtaacattactctactatatacttacaaatttgataagaagatagatctcatgttatttgttcttgctgcagttaaagaacaaagaaatagcaaaatgcatgtgttgatatttgaattcagaacttagatcactttccaatctttgtgtgttactttcagagtcaattactggctaggtgtgatggcttatgcctgtaattccagcattttgggagattgaggcaggtgggaggattgcttgagcccagaagtttgagacgagtctggccagcatagtgagactctctatctaaaaaaataaaaaaggaaaattagtggggcatgatggaacatgcctacagtcccacctactcaggaggctgaggcagaaagatcccttgagcccaggagtttgggactgaagtgagctgggatctcactattgcactgtagcctgggcaacaggtgagaccctatca

SEQ ID NO: 275897 - DNA, 354 bp, Homo sapiens
ctcatggccagtaaataatgaaaatataggattactaatcaaagaaatgcaaattaaaatcagagctgggcatggtggctcacgcctgtaatcccagcagtttgggaggcccaggcgggcagatcacctgaggttgggagtttgagaccagcctgaccaacatggagaaaccctgtctctactaaaaatacaaaattaggcgggcatgatggtgcatgcctgtaatcccaactactcgggatgctgaggcaggagaaccgcttgaacccgggaggcggaggttgtggggagctgagatcgtgccattgcactccagcctgggcaacaggagtgaaactccatctcaaaaaaaaa

SEQ ID NO: 275898 - DNA, 794 bp, Homo sapiens
attccattttgaggaatggggaaggctattctaaagaagaaaaaaaatgggacaggttttctgggtagatctgcaagtctggctttaagagcacaaggaggaaaagtaacaaaagggctggactactgtaaaagttacaaatacgtagttagaccaatagatctatatagtcaggtttttgtcatgtaatttattaactattacagaaacacaactaagaatatcaagtatttctctggctcttgatagaaaaaaaaaatcagctgacttaatcctttgctgtcaaaagagttggcgtttcctgttctgggtgctactgccaaacgttctggtgcttagaggtgggatgcacgacgtcaaccaccgacttatcaatgcagccggctgtgtgtcacaattggccgttaccttaagcactgagccacacgggattagttcagccatttcaagaggtacatttaacgtcggcagttctgctttactaaaatgcagtagaggtactcttctgtcccttccgtttatagttctctgagagagttatattttttggttttgttttgtgttttcttttgaattttatatcttgtatttatccctgaacatgttttgtacttttttttttttaagaaaaggaattattttgtgtatatatagacacttgcatgatatactgtagtcaatgttcggttcctcgaaaggtcttgctgctgtcaggtgttatacactccatccatcataactgtatgaaacacatttcatatgtaaataaacgtgggacatttgaaaaaaatatt

SEQ ID NO: 275899 - DNA, 807 bp, Homo sapiens
gttcttaagtaggctcttttttctctaaattacagaatagcaaactaactcctaagcaagatgagtcagtgtctatgaccttgcctctttcttcctttttagtatcctcaccaaccttccctctgttgacttttgtaatccaggaatttggaactacttatgacttagtgccttggcataatcacatgccatagatgaacatgttcaagactcagttcaaatttaactttctgtgaagccctacctgacttccctaggcaggtattttctccatgcctatagtatattgaaactttttctgttaaaataacataacatttcaattacacacacacaacctgtctcttccactgaacttctctctccccctttgtattctcagtgtctagctacacataataggactttgataaatatttttgaatgaaggtaatagaaaacccgaacttctctatatttgtgtactttcacaaacaaaggcttagaattccacatgaaagtccacatgaggtaagtgtgcattcatgagcatgtgtgcactctgggcaaaccaacagaagataaacagcaaggaagagcagttgttttgtgaaaaataatcatctgttagctgtaaatcagaaatattggccaaatcagaattcttgtttctaaaatgaggcttctaaaattttcacataactgccaaactcttatttgtaattcttaaatatgccctaaagatcatctttctcttttatagacatttagtgtatacagtccacataaatacatatactgattacctacagacaataatgagacttc

SEQ ID NO: 275900 - DNA, 440 bp, Homo sapiens
actacctatcagggcagctcccccagtgccgagaccagctcggtcctggagaccctaacccagcggtgctagaggaattaaagatacacacagaaatatagaggtgtggagtgggaaatcaggcgtctcacagccttcagagctgagagcctccaacagagatttacccacgtgtttattcacagcaagccagtgataagcacagtttctacagattatagattaaaagtaccccttagggaaacaaagggatgggccaaaataaaggggtgggtttggctagttatctgcagcaggggcatgtccttaagtcacagatggctcatgctattgtttgtggtttaagaacgcctttaagcggttttctgccctgggtgggccaggtgttccttgcccttattccggtaaacccacaacctcccagcgtgggcatcatggcc

SEQ ID NO: 275901 - DNA, 151 bp, Homo sapiens
ccacaggctcctaaagtgctgggattataggcgtgagccaccacacctggcctggaatagcatttgctttagaatattctctgtctctctctctctctctggcctggaatagcatttgctttagaatattctctctctctttttttatttt

SEQ ID NO: 275902 - DNA, 304 bp, Homo sapiens
ctactcaggaggctgaggcaggagaatcacttgagtgcaggaggtggcggttgcagtgagccgagatcgcgccactgcactctagcctgggttacagagcgagactctgtctcaaaaaagaaagaaagaaaaaaaaaagaagtaaatgaggggactcgagtctacttgatggttagtattaattgtaataatataaagaatctcatggctgagaaccatagtttgactaggaaatctaaatggcttcaaaaaaccctccccatggatctttgctttgaaaagagaaatttccaaacatgcgaat

SEQ ID NO: 275903 - DNA, 472 bp, Homo sapiens
cgaggatgagttgtcagctctgaaacagtcctgtgctcccaggagaaatccctggctcctcatttcttccgtcttctacttcctcttccatcccacccctggcctcagcctcaccagccttgctgctttcccgctgggttccctccctgcctccagctgtgtttcactccacataaatatgaccaccctccttccctgattaaaaccattcatggatctgggcgccgtggctcatgcctataatcccagcactttgggagccgatgtgggtggatcacctgagtcaggagttttaagaccagcctggccaacatggtgaaaccccgtctctactaaaaatacaaaaaaaatttagccgggcatggtggcacgtgcctgtaatcccagctatttgggaggctgagacaggagaatcacttgaaccttgaagcgaggttgcagtgagctgagatggcgccactgcactcctgcc

SEQ ID NO: 275904 - DNA, 437 bp, Homo sapiens
tgcattttatgcaaggttaaagaagttttcagtgctggctagtgaaatgggggttagatgccctgtctatactacatgtttaatcaatgtaatcttaaaatgagatgaccttgtagccaagcattttttctttcctttataagcaatattaactatattaaatcaagaaagctaatagtttttcgtatttctcaataaccattaagttcaaacattggaagagtttaatattttacatgaaaaatccacaggcaataattttaagtgacttagaaaatatttaccgtattttaaccttaaatgactgtgtatgtgtgtgtgtgcctatgtatgtgtatgtatgtttataatctagtagttctcaaggagtattggagaaagaatatgtgatcacatgtagtttataaaagctctcgtgttttttgaaagacaaattt

SEQ ID NO: 275905 - DNA, 1503 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 275906 - DNA, 1727 bp, Homo sapiens
  misc_feature (1526)..(1526): n is a, c, g, or t
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtaaacaaaaacaaaaaaaaaaaaanaaacccggggcaaaacacagagcgcgacaacaagcgcagaaacgcgcacatggggcaatgcgggtcctgaaccaagattgtgtccaaggggaaaccgcggcccaaaaggagcgcaaaatcgaaagcaggcaccgtagacccgcgaagcacaggcacccaaagacaacggcaaggaacacgaaagaggccaacaccacaaaa

SEQ ID NO: 275907 - DNA, 1431 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 275908 - DNA, 1393 bp, Homo sapiens
aggctgtgcagctctggctgggggcttttttccggctgtgttagccctgctgtggaaagcaagtggactgtcctgcagcccagacaagcccagtggcctttgtgcttttaattgtgataaatgtacctgctttagaaaatgtttaattatgttggaagcaacttaaactgttggatgcctacggctctctcagaagtttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccagggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 275909 - DNA, 294 bp, Homo sapiens
ctgtcactggctgcccggctgttgcagttcccatcactgtttattccttcctctgtgtaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggtaaccgctccctggactctgggctgctgggcagtggcctccgggccagctgagagactcccatgcaactgcgcagtt

SEQ ID NO: 275910 - DNA, 1582 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaagcagtcacagccagtcgtgacagcttctgacatctccaaaaggaagtgcacctcgtcctttgtagaaatgggatcacagggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 275911 - DNA, 1704 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaatagtggcaatggggtcttgaattactaccttttaatttctatatggaaaagaactcactttgaccaacacttctgtaaattacattacaatataggttccttcacactattatccatgtaaaaacaattttgctttgcttcaaacccagatttcaggaaaacaacaacaaaattctccaaactttacta

SEQ ID NO: 275912 - DNA, 1582 bp, Homo sapiens
aaagaaacaaaattgggatgttcgggttggagagttagcaggggcatctccaggagggtcctgccccccaccccaaagccggcctcagggagttccaggcgttcccacactccccaggcaggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaagagatagttctgcaggtcaggcatgggtgagaaagtccctgaggctgcggtatctgaagcctccagagcagcatcttcaagggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 275913 - DNA, 536 bp, Homo sapiens
gaagtttaatttggaccttactcatccagtagaagatggaatttttgattctggaaattttgaaccttccctagtgaatatctagggttctcttccctagttttgcattttttctgttttaaaataggagcaatttctacgggagaaggttaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaaaaaaaa

SEQ ID NO: 275914 - DNA, 450 bp, Homo sapiens
gaagtttaatttggaccttactcatccagtagaagatggaatttttgattctggaaattttgaacaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaaaaaaaa

SEQ ID NO: 275915 - DNA, 466 bp, Homo sapiens
aaatcatctttggagaaaggcatagacatacctctcaggcgcttatccttaaccttggcaatggaaactttccacattgattgagacctgtctcagatacttttggttcacagaagtaaacgtcttttcccagctttcgtatattttgcgtgctccctttgattctgtcaggcttttattttattctttattagggtgggtctatttaggtttttgatcttattctaggacatgatctttacttctaaggcatggcttttctggagttataactgtaaggggtgctcagtaaggtatctctactgtggctctcagtaagaattccgacattttctgcactatgtaaactctgggtctacctttgttacaggtagttagacaggtatgagcgggacaggagagggctctccccccatccaccaggaatgtcgggtgatgatttggcagttatcacattgcctctcta

SEQ ID NO: 275916 - DNA, 447 bp, Homo sapiens
ctccagaatctcctggccaggttcaacctccaccattactgtgcattgtccaaatcttccttgcacttagcaccctggcgcatgtgtgtgtgatcacaggccagccagtgagtgtgcacttggaaagttcactcatccttaaaaccgtgaggcccagaacaaaaacaatcagatgttctgaaaagtatcagtgttaaatactgaagtatcttcttgttaaaatattcttcttgatctgtctctcatattcaatcattcactaactcaatttcagacatttattgagcacctactatgtgccagacattatgctcagcctacctgtcatggtctcttgaaaagaatcttctaaacctgcatcttaaaattacctttggggattgtgctgataatgtgtattcaagtcttgtggtgaacaggaggaaaaatatatcatcttacatttgc

SEQ ID NO: 275917 - DNA, 658 bp, Homo sapiens
ggaacataaatcaatgaattatgcctactaaatgttcagattttgacgtgaaagtcaactgaagagataagacaagaggaaagaaaacgagaggagtaacaagatgagtagaggtaggctttgaaggagcaggagggaagtgggcagcaacccttccacagtgaagaagagaatcagtgatgcagaggcattaaatagaacagatctgaggcttggcagagggagaggccaacaggagctccagacaagcctgggcaacttagcgagaccctgtctctacaaaaaaatttcaaaaataggtaggtgtggtgtcatgcacctgtagtcccagctactcaggaggctgaggcaggaagatcatttgagcccaggaggtcaaggcttcaggggactatgatctgcaccactgcactctagcctgggtgaccgagcaagaccttatctcaaaaaaaaaaaaaaaaaaaaaagagggggccaaaactgccacttcagtgcaccttgataattctcataggcactgctgagccttgcagaggaccacactttcagaatactgtaatggtgaaaccagtctatcagggaaattcctgcccatttctaatctgaaagatgccagtcaaacatccccccatccatgtgtgcagaataaactctaggg

SEQ ID NO: 275918 - DNA, 356 bp, Homo sapiens
gagataaggtcttgctcggtcacccaggctagagtgcagtggtgcagatcatagtcccctgaagccttgacctcctgggctcaaatgatcttcctgcctcagcctcctgagtagctgggactacaggtgcaagaccttatctcaaaaaaaaaaaaaaaaaaaaaagagggggccaaaactgccacttcagtgcaccttgataattctcataggcactgctgagccttgcagaggaccacactttcagaatactgtaatggtgaaaccagtctatcagggaaattcctgcccatttctaatctgaaagatgccagtcaaacatccccccatccatgtgtgcagaataaactctaggg

SEQ ID NO: 275919 - DNA, 505 bp, Homo sapiens
tgttctctctgcttagagagcacctagagaaaatctgtaagcaaataatcacaaaacaagggatgacacaatatatgtaaatgtaggatattacattaagtggaagaaggaagaaggtcattatttactttttctgggtgagagatgaaaacacttctgcaagagtatttccaatttcaccaaagtatggaaagatgtttatcctaataacaatactcagtaatggtatttgatttaatttcagcctagtacatgatttgattctaaaacaacatttccttagaatttcaatatctggaattctatagctcaatggttttggtgactattaatattttatatacttcttttgatagttttggggctaagtgaatcaaatctattcataactctaagttttcaaattctgaaatcttttagagttgtttagttaaaactggttcttttcttccagtttgttagcttaccaaatgagccaaaataaagaaaaaacaaaaatttattt

SEQ ID NO: 275920 - DNA, 1295 bp, Homo sapiens
gcacctcaggggcttttctctaaggctattctgtttctccaggcaagagtctccagttctctgctgggggtgtctgcttggctccagtgttctgggagccctgtaggggatggtcactagggagggacagtcgcccaccttccacaacgtgaacctgtactgcttcccccatttctggtgaagattctcccccatatccactccagtctcttatgtaggtaggtgagggggctgggggtcagaccagaaaaaagtcccctgttaaagaaaaaaaattattcaatgatcctttttttttttttgagacgaagtttcgctcttgttgcccaggctggagtgcagtggcgccatctcggctcaccgcaacctctgcctccttgttcaagcgattctcctgcctcagcctcccgagtagctgggattacaggcatgtgccaccatgcccggctaattttgtatttttagtagagacaagatttcaccatgttggtcaggctggcctcgaactccctacctcaggtgatctgcccgccttggcctcccaaagtgctgggattacaggcgtgagccactgcacccagccctcaatgatactttttaaagcatgctgaggaagaacatattcaggagcatggcaggcacagggaccactgcactggggccttatagttaaggggagagactgggctctgaatacagcatgggccagtgggaatctatagccaaggggcagggtgagcatcagtgggtggaaaatcccagaggaaacatcagtggtgaagggggattctggttgaaccaatctaacaggattccaactgaagacaggcctcagcgtaaccagacattgcctgggggtggtgcagggaaggagcctcaagagtgatcagttatcaagggttctggctaaactgacttagcagggttctttactgaaactggattttacaaggacgtgcatatatgggcacctaggagaaggttccggagcctaaggctggaccaagcacagcatcttcatcagccctaccagccccttccctggtgcgtgctgcctctgaggtctgagtcccctgggttctgaggcaggacctggccacttctcaccacgctgctttctctgccctgtcatttaccctcctccatccttgtccattgtcttccagagctgcacttcctccatctctgctattgcctcctcccctgctccctttttcctgttgggatttcacctttaatggggcttcagcagggcagggacataagcacatgttttcattacaccatgtgacacc

SEQ ID NO: 275921 - DNA, 2916 bp, Homo sapiens
tgtgtccccacccaaatctcaacttgaattgtaccttccagaattcccacaggacccagggggaggtaattgaatcaagggggctggtctttcccatgctattcttgtgatagtgaataagtctcacgagatctgatggttttatcaggggtttctgcttttgctgcttcttcatttttctcttgctgctgccatgtaagaaatgcctttcacctcctgccatgattctgaggcctccccagccaggtggaactataagtccaattaaacctctttttgttcccagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctccaggtcatgtcagagaccttcatggcagcccctcccatcacaggcccagaggcccaggaggaaaaagtggttttgtgggctgggcccagggtctctgtgctgtgtgcagcctagggacttggtgccctgtgtcccagctgctccagccatggctgaaaggagccaacatagagcttgggctgtggcttcagagggtagaggccccaagcattggcagcttccatgtgatgttgagcctgtgggtgcagagatgtcaagaattgagatttgggaacctctgcctagatttcagaatatatatggaaacacctggatgtccaggcaaaagtttgctgcaggggcagagccctcatggggaacctctcctagggcagtgtggaagggaaatgtggggcagagcccccacacagagtccctgttggggcactgcctagtggagctgtgagaagaaggccacagtcccagaacggtagaccccagaatggtagaccccagaatggtagatcaaccaccaacttgcatcttgtgcctggaaaagctacagacactcaacatcagcctgagaaagcagccaggagggaggctgtactctgcaaagccacaggggcggagctgcacaagaccatgggaacctatctcttgcatcagcatgacctgaatgtgagacatggagtcaaaggagatcattatggagctttaaaatttgactgccccactggatttcagacttgcatggaccctgtaacccctttgttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactgttgggaaggaatgattggttttgaaatgtgaggattatgaaatttggaggagcccagggaggaatgatatggtttggctgtgtccccacccaaatctcaacttgaattgtatctcccagaattcccacatgttgtgggagggacgcagtgggaggtaattgaatcatggaggccagtcttttctgtgctattctcgtgataataagtcccacaagatctggtgggtttatgaagagtttctgcttttgcttcttcctcattttgctcttgatgccaccacgtaagaagtaccttttgcctcccacctgattttgaggcctccccagccatgtggaactgtaagtccaattaaaccctttttgtttccagtctcagatatgtctttatcagcagcatggaaacgaactaatacaatcatagtttttaaaaaccaatctaaatgtaactattgaacatgattagctgtttcatccctagtagagtgacagaaggaaacatccatagacaggagtaataagaaaccagctaaacttctaaaccatttttaaaggatgcgtgtgagctggcataacctacctactctttcctatgggcctctactgagagcatggaggtaatacatctaatacactgaagaccagggcaagagagctggaagaaatccctcttaagcactccaggccttcactgagtatgaggtgctggtctccaaaggcagagggcaaggcaaggcagagagggatctcctggggcacagacaactgacaaaagaaacacttggattgttgtataagaggagtgagctttgtaaataccacgttagctggcctgctgtggaacagaatgcctatgaatgacagtagtcaggtagtggatgaacactgatctgagagcctgtaaaagaaactctttggaatgataatgtcatctagacctttgatacgcaaagtgtgattcctggacagatgtattggctttacctggcagcttgttggaaatgtaaaacctcaggcctcaccccagacctactgaattatttatattaattaaaattaaataatttttatttcaacaaaa

SEQ ID NO: 275922 - DNA, 3116 bp, Homo sapiens
  misc_feature (1099)..(1099): n is a, c, g, or t
  misc_feature (1319)..(1319): n is a, c, g, or t
  misc_feature (2220)..(2220): n is a, c, g, or t
  misc_feature (2343)..(2343): n is a, c, g, or t
  misc_feature (2405)..(2405): n is a, c, g, or t
agactctggccgcggcgattcaatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaatatatgcatgactcttggccagtgattctcaacctcggctgcacattggcatcaactggggaaccttcaaagctcctggcatgtgggttccaccctcagagattgtgatgtaatgcactgacagtcaaattgggaacaactgtaaattggctcagttcattcatcttttactgctgtacagaagatttcattgtataagtacttcacaactcatgtactgatttctagttgatgaactgtttcaaatttttgttatttcaagcaattctctaatgaatgttgttgtacttgtctccccgtgaatgttcctctggggtatatactgagaagtttgaattggcacatcaaaggttgagcatcttcccctttaccaggtattatcaacatatcgttttccaaagcatttacagaaatgtgtgctcccaccacttctctgcctctttgacaacactcagtatgatcacacattttttttttgccaattttatgcatgtgaaataattttattgttttagttgtttatttatcttagagaaaaggtcttgcagtaggctcctaggctggagtgcagtggtgcgatcgtggctcactgtaacctcagcctcctgggctcggacagtcctctcgcctaggcgtcctgagtggctgggactacacttgcgcatcatcaccatgcccgggtagttcttttgtttttatttttagagacagggtcttgctgtgctgcccaggctggtctcgaactcctggcctcaagtgatcctcatggcttgaccgccccaagtgttgggattacaggcatnagccaccatgtccagcaattgttttattgttttaaattgtatttacttgattatgagtgaggtttagcatgtaagttactgcttctatgaattgtcttttgcctaatttttctattgttcttttgctctctcttatcctttctctctctctccctccctccctctgggctcctgtctcctcatttgtggactgtgcaattgctgacaccctgcacagctnggccctcaatccagaaacagctgttgacatggtatttctagtgccttcccaaagtaatactgagtacatcacagatccattagccaacccatgtagtgattgagttacttcttggtctcctgtaccctgagccccagacagtgagtctatagctttccttcccatctcctttcaaaaacagggaagtaaagtagccccaccacagtccctgtctttaaaaagtgatgcttgctctggttctctggctttcatgaagcattttcagatcttgctgccatccctgctccagcctactcactgctagtgtttctgtcctgtttctattccgtgagacaactatcatggttgggagtccagaaagctttttgtcaatttttctacttgatccttaccatagatatggcgcaggagggctaggtcagagttagaacttactacacatcttgaacattatatgttatgttttatggtgaaaaaattttaaattctattttagcatctaaatttgcatttaagatgtcactttcttctcaatttattttttctgcaagtaggggaaagagcctgtgagctggatggcagagaaaactagtttttaaattaatattgccaaatatttcagtaaccaaccaactataaaacataataagagctgtcacaattagtaaagattagaagcaatggtaactctcatacagacacccctgggaaaatatgatttacctgtatgctttgtatttttgttccttgaacgttttttggaagcaactgcttccagaaactttcctttgaatagtcaaaaaatacagccattggtgtattattttgttgaatattaaaccagacctatgaaaacattaatataacattagtgtaggtccataggaacacaaggcccatngttggtaaggaaggagcaaaattttacagtcttactactcaatgaagtggcagaatcccagcggggttctgaggcaggagataaagagattctagggtttcatgatcattagactacctcaanggttctcatccttgaaggcactacacaatcacctggaggagctttagtgataaaagattgcnccggccccatgccctagggaatctgatagactatctatatttaaagttccccaggtgattctagtgtgtagccagggtgactctagaggagataactcaagattttttttccccatatacttacatttctatcatcaaacaaacaatctacactttttaagggacaaaacgggtcaaactgcttataacattggccagttgatggattccaaagcaaatattcattagtttcttgagttactacataagccacatgcccctgtatgagaaaaaagaaagtaatttttggtggatttaaataatttctatatatggaaattatactgtgatgattctaatttttaaagccttttttagtggagtgtagtggcttgtacctgtggtcccggctctttgggaggctgaggtgggagggtcacttgagcccaggagtttgagaccagcctgggcaacatagggaaaccctgtatctatcacaaaaaaatttttttaaaatttgctgggcacagcggcacacacacctgtagtcccagctacttgggaggctgaggtgggaggatcgcttgagcctggggagttgagactgcaatgagctgtgataatgccgctgccctgtggcttgggtgacagggtgagatcctgtctcaataacaaacaaacaacaaaaataaataaaagcctttttgagggcttttacattttctttgaaat

SEQ ID NO: 275923 - DNA, 892 bp, Homo sapiens
tttttttttatatttcagaagaagtttattaagaggttttaggctttaagcatatgtgaaaagcaaaaattacattttaaagtatataatttgcattttccaccttctcaatgccaatgaaatattctaggagactctataagataaccaattgattttctactactcccaaattttaactttgtaatttaaagaggaataggcaaatagagctgctgtggttctggttctccctgcaggatgaagggggcctgcaaaatgtctcctacttccattctagtcattcagcaaggtgccttcctctggatgcactgtctgtatacttttgccatgttgcatcacataatgattctgcccaccttcaccatttgactgtcagtaaaagaatgtatgtgctcatttcttcttttattatagcgcagtgctcttcatgaagtctgaatcttgtttcatttgtgattgtaattagcacttgcttcttcaagactggctaaatgatgataatcagtgaagttctgtgatgggcacatggatgtgtattatatttttctactttggttaatatttgaatattccaataagttttaaaataacttgtttgtttctgttattagaatggcctgtccagaagacagccaaatacatccttcaaacagacttcactgcaggagacagagtggattcatcctgtattctccatgtagacttccatcttcatgagtactccaagaagatggttcagttgactattgcaaaggtaaaaatccaagagatacagatacagaataggacagagagacatatttttaagctattgattacaattatggtatgcctatagattgcagaaccgaggagaaagggaacattatgatttaccatcaagaaaaac

SEQ ID NO: 275924 - DNA, 812 bp, Homo sapiens
aaactaggctaggtacgaggctggtgttccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaataatggcctgtccagaagacagccaaatacatccttcaaacagacttcactgcaggagacagagtggattcatcctgtattctccatgtagacttccatcttcatgagtactccaagaagatggttcagttgactattgcaaagatcaccgccagatgcaaaaaaccaccgctaagcattttgtaaaatgctgagacatatttgagcaactcttgatgaaggccctgaccacatttctttcatgttctagacaaaatacctggagagaatggcaagcttccaggctcttgctcagcctttcttctcccttgtcagtgcagtcagggataagcatctatttttaattaatagtatttcttaagaatgaaaacaccattcacttttgcaactgtcaacttaagtacagctgctgttttgagctatgtcttttataatcggagtggattccatacctctcatccctggattttcatcttgtggcactggatgttgaatggctcaagtgcctctgataagaaaaaaattgtgcttcaagtttatgaataagtagga

SEQ ID NO: 275925 - DNA, 457 bp, Homo sapiens
tgcagcagagctccacaaaagtgcgggaatgtctgacagggaagaatcagagaaaccttcaccagcagcccgacattcacctggacggacagtgcacttttcttacgtctgggcagggaaggcagggcggggcacagacaactgacaaaagaaacacttggattgttgtataagaggagtgagctttgtaaataccacgttagctggcctgctgtggaacagaatgcctatgaatgacagtagtcaggtagtggatgaacactgatctgagagcctgtaaaagaaactctttggaatgataatgtcatctagacctttgatacgcaaagtgtgattcctggacagatgtattggctttacctggcagcttgttggaaatgtaaaacctcaggcctcaccccagacctactgaattatttatattaattaaaattaaataatttttatttcaacaaaa

SEQ ID NO: 275926 - DNA, 654 bp, Homo sapiens
agactctggccgcggcgattcaatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaatgtgagttaatcattaacatttcctagtggttaaaattactttttaagcgcttaactgtgtattttttagattgaagatttcaaatgaaattttgatttgactgaaatatttaatatgtgatgagttgatattaaaatacagaagattactatttttatagaaacaataatgtagaaactaatatttgaagcaggtttactccacatactgtgttataatttaaattttcacttaaactctcaaaatcagaagagctgacctagtaaggcttaaacctctaaaacttgtggttttaacaaggcttaatatacgtagttataatagtttttaaaaaaattgttatcaagttcctcaggt

SEQ ID NO: 275927 - DNA, 479 bp, Homo sapiens
agactctggccgcggcgattcaatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaatatgcagcaacagaaccagagttgtcatcaagcctctttgggtctttgttccatggtggtccacagaagaaaggaaattataactaaagctcctattactgtgttctattttagatttaaggtttaaaaccatcatattatgcctatgccaggagattctaagctcatgtgttgtgaagaatc

SEQ ID NO: 275928 - DNA, 594 bp, Homo sapiens
cttcacttagaataatggtctccagtttcattcagaattttggcaattgtgaaattgtggctggctggtaaaaaagtgtggaatggcctgtccagaagacagccaaatacatccttcaaacagacttcactgcaggagacagagtggattcatcctgtattctccatgtagacttccatcttcatgagtactccaagaagatggttcagttgactattgcaaagattggtttagagtatatatttcaccaagttctggccagcaggatctgaaaagatgtcagttggcacttctgcaaaatgtgtgtgcaagagatgtgtgcaaggaaaaccttaaacatctttcctgctttggctttgcatgtgaaagaaaatatgatgcttggatgtctgattccaaaatggcggcatggaagcaagctggcttcatgccccccaaccacagacaaccagaaacaaatgtacagcactgagattatcaccagcaatatcccagaaatcaaatatgaagatgagacagttcctggggccacaaagaagtgaaaaaactccaagcagacgggaagataatcaaacttccacatccatgtcacct

SEQ ID NO: 275929 - DNA, 409 bp, Homo sapiens
caggacccagagggagcggagcacgcgcctttgggaatcttcggtgcgccaagtctgttcgccgccggggtctatcacccccgcccctcgcctctgcccgtgagcgtcagctggcttggctttttcagaggaaacagagactctcagacatgaatactgtgacactgaccaccaggccaacttaacatcagcagatatcctgtctcagatgaagaggtatgtttgatttatttcttttttttttttctatctacagatgatccaatatatgtcctagatcccattcattctgtctcctctggggccttatttcatcatttaaccctccctttttatcttcagtataccctttccccacctccctcccctggctttatctgccctatccaacaaaacaaaaacaaaaaga

SEQ ID NO: 275930 - DNA, 3430 bp, Homo sapiens
  misc_feature (1413)..(1413): n is a, c, g, or t
  misc_feature (1633)..(1633): n is a, c, g, or t
  misc_feature (2534)..(2534): n is a, c, g, or t
  misc_feature (2657)..(2657): n is a, c, g, or t
  misc_feature (2719)..(2719): n is a, c, g, or t
agactctggccgcggcgattcaatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaatggattcccaagagctttgaatgaagacatttaagattacttctagtaaccttgcttgtcaaacccatggtggatgtaattaaccatctgtgctcgtaaatcaggaaactgcaaaactgtgagaacactccgacgtcaattgagtatctacatctaacgtaacactggctcatagtgggaaatcaataaatatcacctgaatgaacaagagaatgattatacattaaacaaacaagagcctcatcttgaaatagattattctccccctaggaggcatcaatgctttggtcacagctttgggatgggcaaagcaagatatgcatgactcttggccagtgattctcaacctcggctgcacattggcatcaactggggaaccttcaaagctcctggcatgtgggttccaccctcagagattgtgatgtaatgcactgacagtcaaattgggaacaactgtaaattggctcagttcattcatcttttactgctgtacagaagatttcattgtataagtacttcacaactcatgtactgatttctagttgatgaactgtttcaaatttttgttatttcaagcaattctctaatgaatgttgttgtacttgtctccccgtgaatgttcctctggggtatatactgagaagtttgaattggcacatcaaaggttgagcatcttcccctttaccaggtattatcaacatatcgttttccaaagcatttacagaaatgtgtgctcccaccacttctctgcctctttgacaacactcagtatgatcacacattttttttttgccaattttatgcatgtgaaataattttattgttttagttgtttatttatcttagagaaaaggtcttgcagtaggctcctaggctggagtgcagtggtgcgatcgtggctcactgtaacctcagcctcctgggctcggacagtcctctcgcctaggcgtcctgagtggctgggactacacttgcgcatcatcaccatgcccgggtagttcttttgtttttatttttagagacagggtcttgctgtgctgcccaggctggtctcgaactcctggcctcaagtgatcctcatggcttgaccgccccaagtgttgggattacaggcatnagccaccatgtccagcaattgttttattgttttaaattgtatttacttgattatgagtgaggtttagcatgtaagttactgcttctatgaattgtcttttgcctaatttttctattgttcttttgctctctcttatcctttctctctctctccctccctccctctgggctcctgtctcctcatttgtggactgtgcaattgctgacaccctgcacagctnggccctcaatccagaaacagctgttgacatggtatttctagtgccttcccaaagtaatactgagtacatcacagatccattagccaacccatgtagtgattgagttacttcttggtctcctgtaccctgagccccagacagtgagtctatagctttccttcccatctcctttcaaaaacagggaagtaaagtagccccaccacagtccctgtctttaaaaagtgatgcttgctctggttctctggctttcatgaagcattttcagatcttgctgccatccctgctccagcctactcactgctagtgtttctgtcctgtttctattccgtgagacaactatcatggttgggagtccagaaagctttttgtcaatttttctacttgatccttaccatagatatggcgcaggagggctaggtcagagttagaacttactacacatcttgaacattatatgttatgttttatggtgaaaaaattttaaattctattttagcatctaaatttgcatttaagatgtcactttcttctcaatttattttttctgcaagtaggggaaagagcctgtgagctggatggcagagaaaactagtttttaaattaatattgccaaatatttcagtaaccaaccaactataaaacataataagagctgtcacaattagtaaagattagaagcaatggtaactctcatacagacacccctgggaaaatatgatttacctgtatgctttgtatttttgttccttgaacgttttttggaagcaactgcttccagaaactttcctttgaatagtcaaaaaatacagccattggtgtattattttgttgaatattaaaccagacctatgaaaacattaatataacattagtgtaggtccataggaacacaaggcccatngttggtaaggaaggagcaaaattttacagtcttactactcaatgaagtggcagaatcccagcggggttctgaggcaggagataaagagattctagggtttcatgatcattagactacctcaanggttctcatccttgaaggcactacacaatcacctggaggagctttagtgataaaagattgcnccggccccatgccctagggaatctgatagactatctatatttaaagttccccaggtgattctagtgtgtagccagggtgactctagaggagataactcaagattttttttccccatatacttacatttctatcatcaaacaaacaatctacactttttaagggacaaaacgggtcaaactgcttataacattggccagttgatggattccaaagcaaatattcattagtttcttgagttactacataagccacatgcccctgtatgagaaaaaagaaagtaatttttggtggatttaaataatttctatatatggaaattatactgtgatgattctaatttttaaagccttttttagtggagtgtagtggcttgtacctgtggtcccggctctttgggaggctgaggtgggagggtcacttgagcccaggagtttgagaccagcctgggcaacatagggaaaccctgtatctatcacaaaaaaatttttttaaaatttgctgggcacagcggcacacacacctgtagtcccagctacttgggaggctgaggtgggaggatcgcttgagcctggggagttgagactgcaatgagctgtgataatgccgctgccctgtggcttgggtgacagggtgagatcctgtctcaataacaaacaaacaacaaaaataaataaaagcctttttgagggcttttacattttctttgaaat

SEQ ID NO: 275931 - DNA, 3259 bp, Homo sapiens
  misc_feature (1242)..(1242): n is a, c, g, or t
  misc_feature (1462)..(1462): n is a, c, g, or t
  misc_feature (2363)..(2363): n is a, c, g, or t
  misc_feature (2486)..(2486): n is a, c, g, or t
  misc_feature (2548)..(2548): n is a, c, g, or t
agactctggccgcggcgattcaatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaatggattcccaagagctttgaatgaagacatttaagattacttctagtaaccttgcttgtcaaacccatggtggatgtaattaaccatctgtgctcgtaaatcaggaaactgcaaaactgtgagaacactccgacgtcaattgagatatgcatgactcttggccagtgattctcaacctcggctgcacattggcatcaactggggaaccttcaaagctcctggcatgtgggttccaccctcagagattgtgatgtaatgcactgacagtcaaattgggaacaactgtaaattggctcagttcattcatcttttactgctgtacagaagatttcattgtataagtacttcacaactcatgtactgatttctagttgatgaactgtttcaaatttttgttatttcaagcaattctctaatgaatgttgttgtacttgtctccccgtgaatgttcctctggggtatatactgagaagtttgaattggcacatcaaaggttgagcatcttcccctttaccaggtattatcaacatatcgttttccaaagcatttacagaaatgtgtgctcccaccacttctctgcctctttgacaacactcagtatgatcacacattttttttttgccaattttatgcatgtgaaataattttattgttttagttgtttatttatcttagagaaaaggtcttgcagtaggctcctaggctggagtgcagtggtgcgatcgtggctcactgtaacctcagcctcctgggctcggacagtcctctcgcctaggcgtcctgagtggctgggactacacttgcgcatcatcaccatgcccgggtagttcttttgtttttatttttagagacagggtcttgctgtgctgcccaggctggtctcgaactcctggcctcaagtgatcctcatggcttgaccgccccaagtgttgggattacaggcatnagccaccatgtccagcaattgttttattgttttaaattgtatttacttgattatgagtgaggtttagcatgtaagttactgcttctatgaattgtcttttgcctaatttttctattgttcttttgctctctcttatcctttctctctctctccctccctccctctgggctcctgtctcctcatttgtggactgtgcaattgctgacaccctgcacagctnggccctcaatccagaaacagctgttgacatggtatttctagtgccttcccaaagtaatactgagtacatcacagatccattagccaacccatgtagtgattgagttacttcttggtctcctgtaccctgagccccagacagtgagtctatagctttccttcccatctcctttcaaaaacagggaagtaaagtagccccaccacagtccctgtctttaaaaagtgatgcttgctctggttctctggctttcatgaagcattttcagatcttgctgccatccctgctccagcctactcactgctagtgtttctgtcctgtttctattccgtgagacaactatcatggttgggagtccagaaagctttttgtcaatttttctacttgatccttaccatagatatggcgcaggagggctaggtcagagttagaacttactacacatcttgaacattatatgttatgttttatggtgaaaaaattttaaattctattttagcatctaaatttgcatttaagatgtcactttcttctcaatttattttttctgcaagtaggggaaagagcctgtgagctggatggcagagaaaactagtttttaaattaatattgccaaatatttcagtaaccaaccaactataaaacataataagagctgtcacaattagtaaagattagaagcaatggtaactctcatacagacacccctgggaaaatatgatttacctgtatgctttgtatttttgttccttgaacgttttttggaagcaactgcttccagaaactttcctttgaatagtcaaaaaatacagccattggtgtattattttgttgaatattaaaccagacctatgaaaacattaatataacattagtgtaggtccataggaacacaaggcccatngttggtaaggaaggagcaaaattttacagtcttactactcaatgaagtggcagaatcccagcggggttctgaggcaggagataaagagattctagggtttcatgatcattagactacctcaanggttctcatccttgaaggcactacacaatcacctggaggagctttagtgataaaagattgcnccggccccatgccctagggaatctgatagactatctatatttaaagttccccaggtgattctagtgtgtagccagggtgactctagaggagataactcaagattttttttccccatatacttacatttctatcatcaaacaaacaatctacactttttaagggacaaaacgggtcaaactgcttataacattggccagttgatggattccaaagcaaatattcattagtttcttgagttactacataagccacatgcccctgtatgagaaaaaagaaagtaatttttggtggatttaaataatttctatatatggaaattatactgtgatgattctaatttttaaagccttttttagtggagtgtagtggcttgtacctgtggtcccggctctttgggaggctgaggtgggagggtcacttgagcccaggagtttgagaccagcctgggcaacatagggaaaccctgtatctatcacaaaaaaatttttttaaaatttgctgggcacagcggcacacacacctgtagtcccagctacttgggaggctgaggtgggaggatcgcttgagcctggggagttgagactgcaatgagctgtgataatgccgctgccctgtggcttgggtgacagggtgagatcctgtctcaataacaaacaaacaacaaaaataaataaaagcctttttgagggcttttacattttctttgaaat

SEQ ID NO: 275932 - DNA, 3387 bp, Homo sapiens
tttttttttatatttcagaagaagtttattaagaggttttaggctttaagcatatgtgaaaagcaaaaattacattttaaagtatataatttgcattttccaccttctcaatgccaatgaaatattctaggagactctataagataaccaattgattttctactactcccaaattttaactttgtaatttaaagaggaataggcaaatagagctgctgtggttctggttctccctgcaggatgaagggggcctgcaaaatgtctcctacttccattctagtcattcagcaaggtgccttcctctggatgcactgtctgtatacttttgccatgttgcatcacataatgattctgcccaccttcaccatttgactgtcagtaaaagaatgtatgtgctcatttcttcttttattatagcgcagtgctcttcatgaagtctgaatcttgtttcatttgtgattgtaattagcacttgcttcttcaagactggctaaatgatgataatcagtgaagttctgtgatgggcacatggatgtgtattatatttttctactttggttaatatttgaatattccaataagttttaaaataacttgtttgtttctgttattagaatggcctgtccagaagacagccaaatacatccttcaaacagacttcactgcaggagacagagtggattcatcctgtattctccatgtagacttccatcttcatgagtactccaagaagatggttcagttgactattgcaaagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctccaggtcatgtcagagaccttcatggcagcccctcccatcacaggcccagaggcccaggaggaaaaagtggttttgtgggctgggcccagggtctctgtgctgtgtgcagcctagggacttggtgccctgtgtcccagctgctccagccatggctgaaaggagccaacatagagcttgggctgtggcttcagagggtagaggccccaagcattggcagcttccatgtgatgttgagcctgtgggtgcagagatgtcaagaattgagatttgggaacctctgcctagatttcagaatatatatggaaacacctggatgtccaggcaaaagtttgctgcaggggcagagccctcatggggaacctctcctagggcagtgtggaagggaaatgtggggcagagcccccacacagagtccctgttggggcactgcctagtggagctgtgagaagaaggccacagtcccagaacggtagaccccagaatggtagaccccagaatggtagatcaaccaccaacttgcatcttgtgcctggaaaagctacagacactcaacatcagcctgagaaagcagccaggagggaggctgtactctgcaaagccacaggggcggagctgcacaagaccatgggaacctatctcttgcatcagcatgacctgaatgtgagacatggagtcaaaggagatcattatggagctttaaaatttgactgccccactggatttcagacttgcatggaccctgtaacccctttgttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactgttgggaaggaatgattggttttgaaatgtgaggattatgaaatttggaggagcccagggaggaatgatatggtttggctgtgtccccacccaaatctcaacttgaattgtatctcccagaattcccacatgttgtgggagggacgcagtgggaggtaattgaatcatggaggccagtcttttctgtgctattctcgtgataataagtcccacaagatctggtgggtttatgaagagtttctgcttttgcttcttcctcattttgctcttgatgccaccacgtaagaagtaccttttgcctcccacctgattttgaggcctccccagccatgtggaactgtaagtccaattaaaccctttttgtttccagtctcagatatgtctttatcagcagcatggaaacgaactaatacaatcatagtttttaaaaaccaatctaaatgtaactattgaacatgattagctgtttcatccctagtagagtgacagaaggaaacatccatagacaggagtaataagaaaccagctaaacttctaaaccatttttaaaggatgcgtgtgagctggcataacctacctactctttcctatgggcctctactgagagcatggaggtaatacatctaatacactgaagaccagggcaagagagctggaagaaatccctcttaagcactccaggccttcactgagtatgaggtgctggtctccaaaggcagagggcaaggcaaggcagagagggatctcctggggcacagacaactgacaaaagaaacacttggattgttgtataagaggagtgagctttgtaaataccacgttagctggcctgctgtggaacagaatgcctatgaatgacagtagtcaggtagtggatgaacactgatctgagagcctgtaaaagaaactctttggaatgataatgtcatctagacctttgatacgcaaagtgtgattcctggacagatgtattggctttacctggcagcttgttggaaatgtaaaacctcaggcctcaccccagacctactgaattatttatattaattaaaattaaataatttttatttcaacaaaa

SEQ ID NO: 275933 - DNA, 3820 bp, Homo sapiens
tttttttttatatttcagaagaagtttattaagaggttttaggctttaagcatatgtgaaaagcaaaaattacattttaaagtatataatttgcattttccaccttctcaatgccaatgaaatattctaggagactctataagataaccaattgattttctactactcccaaattttaactttgtaatttaaagaggaataggcaaatagagctgctgtggttctggttctccctgcaggatgaagggggcctgcaaaatgtctcctacttccattctagtcattcagcaaggtgccttcctctggatgcactgtctgtatacttttgccatgttgcatcacataatgattctgcccaccttcaccatttgactgtcagtaaaagaatgtatgtgctcatttcttcttttattatagcgcagtgctcttcatgaagtctgaatcttgtttcatttgtgattgtaattagcacttgcttcttcaagactggctaaatgatgataatcagtgaagttctgtgatgggcacatggatgtgtattatatttttctactttggttaatatttgaatattccaataagttttaaaataacttgtttgtttctgttattagaatggcctgtccagaagacagccaaatacatccttcaaacagacttcactgcaggagacagagtggattcatcctgtattctccatgtagacttccatcttcatgagtactccaagaagatggttcagttgactattgcaaagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctccaggtcatgtcagagaccttcatggcagcccctcccatcacaggcccagaggcccaggaggaaaaagtggttttgtgggctgggcccagggtctctgtgctgtgtgcagcctagggacttggtgccctgtgtcccagctgctccagccatggctgaaaggagccaacatagagcttgggctgtggcttcagagggtagaggccccaagcattggcagcttccatgtgatgttgagcctgtgggtgcagagatgtcaagaattgagatttgggaacctctgcctagatttcagaatatatatggaaacacctggatgtccaggcaaaagtttgctgcaggggcagagccctcatggggaacctctcctagggcagtgtggaagggaaatgtggggcagagcccccacacagagtccctgttggggcactgcctagtggagctgtgagaagaaggccacagtcccagaacggtagaccccagaatggtagaccccagaatggtagatcaaccaccaacttgcatcttgtgcctggaaaagctacagacactcaacatcagcctgagaaagcagccaggagggaggctgtactctgcaaagccacaggggcggagctgcacaagaccatgggaacctatctcttgcatcagcatgacctgaatgtgagacatggagtcaaaggagatcattatggagctttaaaatttgactgccccactggatttcagacttgcatggaccctgtaacccctttgttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactgttgggaaggaatgattggttttgaaatgtgaggattatgaaatttggaggagcccagggaggaatgatatggtttggctgtgtccccacccaaatctcaacttgaattgtatctcccagaattcccacatgttgtgggagggacgcagtgggaggtaattgaatcatggaggccagtcttttctgtgctattctcgtgataataagtcccacaagatctggtgggtttatgaagagtttctgcttttgcttcttcctcattttgctcttgatgccaccacgtaagaagtaccttttgcctcccacctgattttgaggcctccccagccatgtggaactgtaagtccaattaaaccctttttgtttccagtctcagatatgtctttatcagcagcatggaaacgaactaatacaatcatagtttttaaaaaccaatctaaatgtaactattgaacatgattagctgtttcatccctagtagagtgacagaaggaaacatccatagacaggagtaataagaaaccagctaaacttctaaaccatttttaaaggatgcgtgtgagctggcataacctacctactctttcctatgggcctctactgagagcatggaggtaatacatctaatacactgaagaccagggcaagagagctggaagaaatccctcttaagcactccaggccttcactgagtatgaggtgctggtctccaaaggcagagggcaaggcaaggcagagagggatctcctggggcacagacaactgacaaaagaaacacttggattgttgtataagaggagtgagctttgtaaataccacgttagctggcctgctgtggaacagaatgcctatgaatgacagtagtcaggtagtggatgaacactgatctgagagcctgtaaaagaaactctttggaatgataatgtcatctagacctttgatacgcaaagtgtgattcctggacagatgtattggctttacctggcagcttgttggaaatgtaaaacctcaggcctcaccccagacctactgaattatttatattaattaaaattaaataatttttatttcaacaaaaaaaaaaaagggcggccgcccttttttttctgtttatttatgtttttatattttctttggttaacagtgtttttgctgaataaacaccccctcttgggagacgcgaccacatacggggggccatagggtgaggagccgggtttaaacactaataggagatattttgagactcttgcccaattgagacactaactatcggggcgggacaaacaatctgtattcccaaaaacttttggttagtccccacgacggcgaaaattgcagcttgggccgatgtgtgagatcggcaatttaccccgagaaatatagcccaacggcactcgtgaagaggagaataagatttgcgcaaaaaaaacgacgctgtgatcgcaaaaggatattcccagcaagggagaaaacgggtactccttcgaaaggccttcccgaaaacacag

SEQ ID NO: 275934 - DNA, 2734 bp, Homo sapiens
tttttttttatatttcagaagaagtttattaagaggttttaggctttaagcatatgtgaaaagcaaaaattacattttaaagtatataatttgcattttccaccttctcaatgccaatgaaatattctaggagactctataagataaccaattgattttctactactcccaaattttaactttgtaatttaaagaggaataggcaaatagagctgctgtggttctggttctccctgcaggatgaagggggcctgcaaaatgtctcctacttccattctagtcattcagcaaggtgccttcctctggatgcactgtctgtatacttttgccatgttgcatcacataatgattctgcccaccttcaccatttgactgtcagtaaaagaatgtatgtgctcatttcttcttttattatagcgcagtgctcttcatgaagtctgaatcttgtttcatttgtgattgtaattagcacttgcttcttcaagactggctaaatgatgataatcagtgaagttctgtgatgggcacatggatgtgtattatatttttctactttggttaatatttgaatattccaataagttttaaaataacttgtttgtttctgttattagaatggcctgtccagaagacagccaaatacatccttcaaacagacttcactgcaggagacagagtggattcatcctgtattctccatgtagacttccatcttcatgagtactccaagaagatggttcagttgactattgcaaagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctccaggtcatgtcagagaccttcatggcagcccctcccatcacaggcccagaggcccaggaggaaaaagtggttttgtgggctgggcccagggtctctgtgctgtgtgcagcctagggacttggtgccctgtgtcccagctgctccagccatggctgaaaggagccaacatagagcttgggctgtggcttcagagggtagaggccccaagcattggcagcttccatgtgatgttgagcctgtgggtgcagagatgtcaagaattgagatttgggaacctctgcctagatttcagaatatatatggaaacacctggatgtccaggcaaaagtttgctgcaggggcagagccctcatggggaacctctcctagggcagtgtggaagggaaatgtggggcagagcccccacacagagtccctgttggggcactgcctagtggagctgtgagaagaaggccacagtcccagaacggtagaccccagaatggtagaccccagaatggtagatcaaccaccaacttgcatcttgtgcctggaaaagctacagacactcaacatcagcctgagaaagcagccaggagggaggctgtactctgcaaagccacaggggcggagctgcacaagaccatgggaacctatctcttgcatcagcatgacctgaatgtgagacatggagtcaaaggagatcattatggagctttaaaatttgactgccccactggatttcagacttgcatggaccctgtaacccctttgttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactgttgggaaggaatgattggttttgaaatgtgaggattatgaaatttggaggagcccagggaggaatgatatggtttggctgtgtccccacccaaatggggcacagacaactgacaaaagaaacacttggattgttgtataagaggagtgagctttgtaaataccacgttagctggcctgctgtggaacagaatgcctatgaatgacagtagtcaggtagtggatgaacactgatctgagagcctgtaaaagaaactctttggaatgataatgtcatctagacctttgatacgcaaagtgtgattcctggacagatgtattggctttacctggcagcttgttggaaatgtaaaacctcaggcctcaccccagacctactgaattatttatattaattaaaattaaataatttttatttcaacaaaa

SEQ ID NO: 275935 - DNA, 3361 bp, Homo sapiens
tttttttttatatttcagaagaagtttattaagaggttttaggctttaagcatatgtgaaaagcaaaaattacattttaaagtatataatttgcattttccaccttctcaatgccaatgaaatattctaggagactctataagataaccaattgattttctactactcccaaattttaactttgtaatttaaagaggaataggcaaatagagctgctgtggttctggttctccctgcaggatgaagggggcctgcaaaatgtctcctacttccattctagtcattcagcaaggtgccttcctctggatgcactgtctgtatacttttgccatgttgcatcacataatgattctgcccaccttcaccatttgactgtcagtaaaagaatgtatgtgctcatttcttcttttattatagcgcagtgctcttcatgaagtctgaatcttgtttcatttgtgattgtaattagcacttgcttcttcaagactggctaaatgatgataatcagtgaagttctgtgatgggcacatggatgtgtattatatttttctactttggttaatatttgaatattccaataagttttaaaataacttgtttgtttctgttattagaatggcctgtccagaagacagccaaatacatccttcaaacagacttcactgcaggagacagagtggattcatcctgtattctccatgtagacttccatcttcatgagtactccaagaagatggttcagttgactattgcaaagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctccaggtcatgtcagagaccttcatggcagcccctcccatcacaggcccagaggcccaggaggaaaaagtggttttgtgggctgggcccagggtctctgtgctgtgtgcagcctagggacttggtgccctgtgtcccagctgctccagccatggctgaaaggagccaacatagagcttgggctgtggcttcagagggtagaggccccaagcattggcagcttccatgtgatgttgagcctgtgggtgcagagatgtcaagaattgagatttgggaacctctgcctagatttcagaatatatatggaaacacctggatgtccaggcaaaagtttgctgcaggggcagagccctcatggggaacctctcctagggcagtgtggaagggaaatgtggggcagagcccccacacagagtccctgttggggcactgcctagtggagctgtgagaagaaggccacagtcccagaacggtagaccccagaatggtagaccccagaatggtagatcaaccaccaacttgcatcttgtgcctggaaaagctacagacactcaacatcagcctgagaaagcagccaggagggaggctgtactctgcaaagccacaggggcggagctgcacaagaccatgggaacctatctcttgcatcagcatgacctgaatgtgagacatggagtcaaaggagatcattatggagctttaaaatttgactgccccactggatttcagacttgcatggaccctgtaacccctttgttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactgttgggaaggaatgattggttttgaaatgtgaggattatgaaatttggaggagcccagggaggaatgatatggtttggctgtgtccccacccaaatctcaacttgaattgtatctcccagaattcccacatgttgtgggagggacgcagtgggaggtaattgaatcatggaggccagtcttttctgtgctattctcgtgataataagtcccacaagatctggtgggtttatgaagagtttctgcttttgcttcttcctcattttgctcttgatgccaccacgtaagaagtaccttttgcctcccacctgattttgaggcctccccagccatgtggaactgtaagtccaattaaaccctttttgtttccagtctcagatatgtctttatcagcagcatggaaacgaactaatacaatcatagtttttaaaaaccaatctaaatgtaactattgaacatgattagctgtttcatccctagtagagtgacagaaggaaacatccatagacaggagtaataagaaaccagctaaacttctaaaccatttttaaaggatgcgtgtgagctggcataacctacctactctttcctatgggcctctactgagagcatggaggtaatacatctaatacactgaagaccagggcaagagagctggaagaaatccctcttaagcactccaggcccttaccagacaccaagcctgccagcaccttgatcttgggcttcttggcctccagaactgtgagaaaagtaatttctgttctttatattataaattaccaagtttgtcacattctgttacagccacacaaaacagactaagacatctggtaacacaggcaagtatgatcattaacttttcatggtcccttcagacacagtgtgtcttcaaaaactttcttaaaagttcctgtagctttaatggtaacttcagcagcctcactgagactggaggccgtatagatatggggcagatatctccctaggatggaaacaattctacctacacaaatgtcatagtaccaggcttcttggtaagtctatttaggcg

SEQ ID NO: 275936 - DNA, 3104 bp, Homo sapiens
caggacccagagggagcggagcacgcgcctttgggaatcttcggtgcgccaagtctgttcgccgccggggtctatcacccccgcccctcgcctctgcccgtgagcgtgtgagttgtagcgtaccctggggtctgttctggaggaggcctgagagcggggttgcctggggcgtgggtctctcatccctctcgtcctggtgaagaagaagagtatacccagcggcagctggcttggctttttcagaggaaacagagactctcagacatgaatactgtgacactgaccaccaggccaacttaacatcagcagatatcctgtctcagatgaagagaatggcctgtccagaagacagccaaatacatccttcaaacagacttcactgcaggagacagagtggattcatcctgtattctccatgtagacttccatcttcatgagtactccaagaagatggttcagttgactattgcaaagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctccaggtcatgtcagagaccttcatggcagcccctcccatcacaggcccagaggcccaggaggaaaaagtggttttgtgggctgggcccagggtctctgtgctgtgtgcagcctagggacttggtgccctgtgtcccagctgctccagccatggctgaaaggagccaacatagagcttgggctgtggcttcagagggtagaggccccaagcattggcagcttccatgtgatgttgagcctgtgggtgcagagatgtcaagaattgagatttgggaacctctgcctagatttcagaatatatatggaaacacctggatgtccaggcaaaagtttgctgcaggggcagagccctcatggggaacctctcctagggcagtgtggaagggaaatgtggggcagagcccccacacagagtccctgttggggcactgcctagtggagctgtgagaagaaggccacagtcccagaacggtagaccccagaatggtagaccccagaatggtagatcaaccaccaacttgcatcttgtgcctggaaaagctacagacactcaacatcagcctgagaaagcagccaggagggaggctgtactctgcaaagccacaggggcggagctgcacaagaccatgggaacctatctcttgcatcagcatgacctgaatgtgagacatggagtcaaaggagatcattatggagctttaaaatttgactgccccactggatttcagacttgcatggaccctgtaacccctttgttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactgttgggaaggaatgattggttttgaaatgtgaggattatgaaatttggaggagcccagggaggaatgatatggtttggctgtgtccccacccaaatctcaacttgaattgtatctcccagaattcccacatgttgtgggagggacgcagtgggaggtaattgaatcatggaggccagtcttttctgtgctattctcgtgataataagtcccacaagatctggtgggtttatgaagagtttctgcttttgcttcttcctcattttgctcttgatgccaccacgtaagaagtaccttttgcctcccacctgattttgaggcctccccagccatgtggaactgtaagtccaattaaaccctttttgtttccagtctcagatatgtctttatcagcagcatggaaacgaactaatacaatcatagtttttaaaaaccaatctaaatgtaactattgaacatgattagctgtttcatccctagtagagtgacagaaggaaacatccatagacaggagtaataagaaaccagctaaacttctaaaccatttttaaaggatgcgtgtgagctggcataacctacctactctttcctatgggcctctactgagagcatggaggtaatacatctaatacactgaagaccagggcaagagagctggaagaaatccctcttaagcactccaggccttcactgagtatgaggtgctggtctccaaaggcagagggcaaggcaaggcagagagggatctcctggggcacagacaactgacaaaagaaacacttggattgttgtataagaggagtgagctttgtaaataccacgttagctggcctgctgtggaacagaatgcctatgaatgacagtagtcaggtagtggatgaacactgatctgagagcctgtaaaagaaactctttggaatgataatgtcatctagacctttgatacgcaaagtgtgattcctggacagatgtattggctttacctggcagcttgttggaaatgtaaaacctcaggcctcaccccagacctactgaattatttatattaattaaaattaaataatttttatttcaacaaaa

SEQ ID NO: 275937 - DNA, 3413 bp, Homo sapiens
agactctggccgcggcgattcaatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaatgaggtaaagcaaggtggctggatagaatcctccagcaatcatctgcactgcaggaacaacaaattgaacaactatccacataagaagcaccttcacaagaaccaaaaatcagcagctggcttggctttttcagaggaaacagagactctcagacatgaatactgtgacactgaccaccaggccaacttaacatcagcagatatcctgtctcagatgaagagatggagtctcgcactgtcgccccagttggagtgtaatggtgcgatctcggctcactgcaagctccgcctcccgggttcatgccattctcctgcctcagcctcctgagtagctggaactacagaatggcctgtccagaagacagccaaatacatccttcaaacagacttcactgcaggagacagagtggattcatcctgtattctccatgtagacttccatcttcatgagtactccaagaagatggttcagttgactattgcaaagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctccaggtcatgtcagagaccttcatggcagcccctcccatcacaggcccagaggcccaggaggaaaaagtggttttgtgggctgggcccagggtctctgtgctgtgtgcagcctagggacttggtgccctgtgtcccagctgctccagccatggctgaaaggagccaacatagagcttgggctgtggcttcagagggtagaggccccaagcattggcagcttccatgtgatgttgagcctgtgggtgcagagatgtcaagaattgagatttgggaacctctgcctagatttcagaatatatatggaaacacctggatgtccaggcaaaagtttgctgcaggggcagagccctcatggggaacctctcctagggcagtgtggaagggaaatgtggggcagagcccccacacagagtccctgttggggcactgcctagtggagctgtgagaagaaggccacagtcccagaacggtagaccccagaatggtagaccccagaatggtagatcaaccaccaacttgcatcttgtgcctggaaaagctacagacactcaacatcagcctgagaaagcagccaggagggaggctgtactctgcaaagccacaggggcggagctgcacaagaccatgggaacctatctcttgcatcagcatgacctgaatgtgagacatggagtcaaaggagatcattatggagctttaaaatttgactgccccactggatttcagacttgcatggaccctgtaacccctttgttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactgttgggaaggaatgattggttttgaaatgtgaggattatgaaatttggaggagcccagggaggaatgatatggtttggctgtgtccccacccaaatctcaacttgaattgtatctcccagaattcccacatgttgtgggagggacgcagtgggaggtaattgaatcatggaggccagtcttttctgtgctattctcgtgataataagtcccacaagatctggtgggtttatgaagagtttctgcttttgcttcttcctcattttgctcttgatgccaccacgtaagaagtaccttttgcctcccacctgattttgaggcctccccagccatgtggaactgtaagtccaattaaaccctttttgtttccagtctcagatatgtctttatcagcagcatggaaacgaactaatacaatcatagtttttaaaaaccaatctaaatgtaactattgaacatgattagctgtttcatccctagtagagtgacagaaggaaacatccatagacaggagtaataagaaaccagctaaacttctaaaccatttttaaaggatgcgtgtgagctggcataacctacctactctttcctatgggcctctactgagagcatggaggtaatacatctaatacactgaagaccagggcaagagagctggaagaaatccctcttaagcactccaggccttcactgagtatgaggtgctggtctccaaaggcagagggcaaggcaaggcagagagggatctcctggggcacagacaactgacaaaagaaacacttggattgttgtataagaggagtgagctttgtaaataccacgttagctggcctgctgtggaacagaatgcctatgaatgacagtagtcaggtagtggatgaacactgatctgagagcctgtaaaagaaactctttggaatgataatgtcatctagacctttgatacgcaaagtgtgattcctggacagatgtattggctttacctggcagcttgttggaaatgtaaaacctcaggcctcaccccagacctactgaattatttatattaattaaaattaaataatttttatttcaacaaaa

SEQ ID NO: 275938 - DNA, 3070 bp, Homo sapiens
agactctggccgcggcgattcaatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaataatggcctgtccagaagacagccaaatacatccttcaaacagacttcactgcaggagacagagtggattcatcctgtattctccatgtagacttccatcttcatgagtactccaagaagatggttcagttgactattgcaaagtctcaggtatgtctttatcagcagcatgaaaatggactaatagtaccagtagagtggggcattgctgaaaagatacccgaaaatgtggaagcaactttggaactgggtgttgaaataatctggagggctcagaagaagataggaaaatgtaggaaagtttggaacctcctagagactgtgaatggcattgacaaaaatactgatagtgatatgaacaataaggtccaggctgaggtggtctcagatggagatgaagaccttgttgggaactgaagtaaaggtgacccttgttatgttttagcaaggagactggcagcatttcacccttgccctagagatttgtggaacttagagcttgagagagatgacttagggtatctggtggaataaatttctaagcagcaaagcattcaaaaggtgacttgggtgctgttaaaaacattctgttttaaaagggaaacaagagcataaatgtggaaaatctgcagcctgatgatgcagtagaaaagaaaaacccattttttttaaggagaaattcaagctggctgcagaaatttgcataagcagcaaggagcctaatgttaatccccaagaccatggggaaaatgtctccaggtcatgtcagagaccttcatggcagcccctcccatcacaggcccagaggcccaggaggaaaaagtggttttgtgggctgggcccagggtctctgtgctgtgtgcagcctagggacttggtgccctgtgtcccagctgctccagccatggctgaaaggagccaacatagagcttgggctgtggcttcagagggtagaggccccaagcattggcagcttccatgtgatgttgagcctgtgggtgcagagatgtcaagaattgagatttgggaacctctgcctagatttcagaatatatatggaaacacctggatgtccaggcaaaagtttgctgcaggggcagagccctcatggggaacctctcctagggcagtgtggaagggaaatgtggggcagagcccccacacagagtccctgttggggcactgcctagtggagctgtgagaagaaggccacagtcccagaacggtagaccccagaatggtagaccccagaatggtagatcaaccaccaacttgcatcttgtgcctggaaaagctacagacactcaacatcagcctgagaaagcagccaggagggaggctgtactctgcaaagccacaggggcggagctgcacaagaccatgggaacctatctcttgcatcagcatgacctgaatgtgagacatggagtcaaaggagatcattatggagctttaaaatttgactgccccactggatttcagacttgcatggaccctgtaacccctttgttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactgttgggaaggaatgattggttttgaaatgtgaggattatgaaatttggaggagcccagggaggaatgatatggtttggctgtgtccccacccaaatctcaacttgaattgtatctcccagaattcccacatgttgtgggagggacgcagtgggaggtaattgaatcatggaggccagtcttttctgtgctattctcgtgataataagtcccacaagatctggtgggtttatgaagagtttctgcttttgcttcttcctcattttgctcttgatgccaccacgtaagaagtaccttttgcctcccacctgattttgaggcctccccagccatgtggaactgtaagtccaattaaaccctttttgtttccagtctcagatatgtctttatcagcagcatggaaacgaactaatacaatcatagtttttaaaaaccaatctaaatgtaactattgaacatgattagctgtttcatccctagtagagtgacagaaggaaacatccatagacaggagtaataagaaaccagctaaacttctaaaccatttttaaaggatgcgtgtgagctggcataacctacctactctttcctatgggcctctactgagagcatggaggtaatacatctaatacactgaagaccagggcaagagagctggaagaaatccctcttaagcactccaggccttcactgagtatgaggtgctggtctccaaaggcagagggcaaggcaaggcagagagggatctcctggggcacagacaactgacaaaagaaacacttggattgttgtataagaggagtgagctttgtaaataccacgttagctggcctgctgtggaacagaatgcctatgaatgacagtagtcaggtagtggatgaacactgatctgagagcctgtaaaagaaactctttggaatgataatgtcatctagacctttgatacgcaaagtgtgattcctggacagatgtattggctttacctggcagcttgttggaaatgtaaaacctcaggcctcaccccagacctactgaattatttatattaattaaaattaaataatttttatttcaacaaaa

SEQ ID NO: 275939 - DNA, 649 bp, Homo sapiens
ggctgtaggaatacggcacgagagacgagctcttacactcatagagtttaagagtgacagaaggaaacatccatagacaggagtaataagaaaccagctaaacttctaaaccatttttaaaggatgcgtgtgagctggcataacctacctactctttcctatgggcctctactgagagcatggaggtaatacatctaatacactgaagaccagggcaagagagctggaagaaatccctcttaagcactccaggccttcactgagtatgaggtgctggtctccaaaggcagagggcaaggcaaggcagagagggatctcctggggcacagacaactgacaaaagaaacacttggattgttgtataagaggagtgagctttgtaaataccacgttagctggcctgctgtggaacagaatgcctatgaatgacagtagtcaggtagtggatgaacactgatctgagagcctgtaaaagaaactctttggaatgataatgtcatctagacctttgatacgcaaagtgtgattcctggacagatgtattggctttacctggcagcttgttggaaatgtaaaacctcaggcctcaccccagacctactgaattatttatattaattaaaattaaataatttttatttcaacaaaa

SEQ ID NO: 275940 - DNA, 1425 bp, Homo sapiens
agactctggccgcggcgattcaatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaatgaggtaaagcaaggtggctggatagaatcctccagcaatcatctgcactgcaggaacaacaaattgaacaactatccacataagaagcaccttcacaagaaccaaaaatcagcagctggcttggctttttcagaggaaacagagactctcagacatgaatactgtgacactgaccaccaggccaacttaacatcagcagatatcctgtctcagatgaagagatggagtctcgcactgtcgccccagttggagtgtaatggtgcgatctcggctcactgcaagctccgcctcccgggttcatgccattctcctgcctcagcctcctgagtagctggaactacaggtgcccgccaccacgcccggctaattttttgtatgtatttttagtagagacaaggtttcactgtgttagccaggatggtctcgatcttctgacctcgttatccgcccgcctcagcctcccaaagtgctgagattgcaggcgtgagccaccgcacccggcctataatactacattttaaatcactaaaaattcaagatggataatgactgagtctcatgtctcctataatatagtagtaagacagttaaattctttcaagacttcagtttttgacctccacaaagacagcaattagaaattgattttctgaggtcccctttggctccaaaatgcaatgattaaagttttcattgaccctgcttactgcctttatagaaataattcccaatatgtggaaagggaatgcagagaatcttaaatgggacataatcactacagttgtttgtatttggagtatatagaattagagccaatgacaacaaggtggattttttttttattgtttagtttaatacttttacaaccttaattttaagggataagagaccattttcagcttaggtgttgatagtgctagagtttcaaagtgtggaatatgtgataaaggattttatgtaaaattagacatagtattaaaaccagagctagacagtaaagaaagcagtaaaaaatagattttactcaggaactattggaataaagtaagggacttgagtatagaactgtgctcagttctgaaaagaagaagaataaggggggattcataccaaggaacagagtggggt

SEQ ID NO: 275941 - DNA, 485 bp, Homo sapiens
agactctggccgcggcgattcaatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggggtgtcctatagactttgtcatggagtgaaacagaaacaaatgaaaccactgccaagaacgatgttataaaggctttcctccacgttctcatctaggagttttatagtttcagcctcgtgaagtgccagctccctctttgccctccaccatgactgcaagtttcctgaggcctcccagaagtttcttgaggcctccccagaagccaagcagatgccagcatcatgcttcc

SEQ ID NO: 275942 - DNA, 338 bp, Homo sapiens
ccaaagaaagaagaagggagcaacagacaccaaggcctacttgggggtggagggtgggagaaaggtgaggattgaaaaactgtctatcaggtactatgctctttacctggatgatgaaataatctgtacaccaaacccctgtgacatgcagttttcccatgttacaaacctgcacacgtacccctgaaactactagaagtaccacattaatagcgtgcatctccttcttcctgccttgttacttcactttttctgttccatctcttaaagaggcatgtaaggtagaatatcaaagtattgagtgttccctttgcttgcttgctggatatccactggta

SEQ ID NO: 275943 - DNA, 271 bp, Homo sapiens
aaagcaggagcaggcatgtgacatggcaaaagcagaagcaagtgagagagagagagagggagagaggtggggaggtggggaagtgctacatacttttaaatgaccagatcttgctagaattcactcactgtcgaggacagcaccaagatgatgatggtaaaccattcatgagaaatcatctcccaccaggttctcccttgaacattgaggattgcatttcaatgtgagatttgggcggggacaaatatccaaactatatcaggggtgatat

SEQ ID NO: 275944 - DNA, 310 bp, Homo sapiens
aggtgtcctctggtggtatcctccagctgcactctccagcccacctcatctctggccccagccgaggttgctaagagtggtggctctgaaaaaaaaaggtggctcctgtgggctccttcctgttggtgggaatttgaaagaagggtagaatagataaaaaaggcctccagccatacgttaggagatgcagagtttggtcctagctccttcttcttggagctgtgtgtttctgtgtgagtgacttcatccctctaagccagtttcctcatatgggaaacaagggtggtaatccttgccccagcctggagga

SEQ ID NO: 275945 - DNA, 660 bp, Homo sapiens
tgtagccatcctccttctttgaagtctcatatgtggaaacatgcaagtgaccaaaattacaactacgaacaagtaaacaaggctattaacgacgcgatttcacaaagtggcagagttctggggaaatcccctggaaagactcaattaaagagcagtgaagagagtgcagatcccgtcactggaagttcggaaaatgcagtgtcatcttcagaactgatgtcccagactcccagtgaagttctgggtaccaacgagaatgagaaactgagccctacaagtaatacctcatatagtttagaaaaaatctccagtctggcccctcctagcatggagtactgcgttttactcttctgctgttgtatttgtggttttgaatcaaccagcaaagaaaacctcttggatcatatgaaagagcacgagggtgaaattgtaaacatcatcctgaataaggaccacaatacagctctaaacacaaattaggtggaataatgactcgagcaggaaagcagtagaagaggattccttcaccacagtttcacctttacgctgtcagacaacttcctgccacagaagaagtcgttgatgtgatttttgaggaaatgacagatgtgactttggaaccaaacttgtaataaaaggaattccaaatggaaaaaaaaa

SEQ ID NO: 275946 - DNA, 368 bp, Homo sapiens
atcaggtatcaaattgtagtggaaataatccaggcgactacaattagcagctttccccaactgaagaggcacaaaggtaagagccagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaaggtagaactttatagtttcttgttttgaccctaccaagtttattataaatgctgatagaactacatataaagactttcaacttagaataaaaaaagaaaaatttttgaagtgattgttccccgc

SEQ ID NO: 275947 - DNA, 2430 bp, Homo sapiens
atcaggtatcaaattgtagtggaaataatccaggcgactacaattagcagctttccccaactgaagaggcacaaaggtaagagccagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagattcttcagtttgaagatatcttggccaatacgttctaccgagagcactttggaatgtacatggaaaggatggacaaaagagctctgattagtttttgggaatctgtggaacatttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaaggcaagctctaaattctattcaaaatgcaccaaaacctgacaagaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaatcacagtgctcta

SEQ ID NO: 275948 - DNA, 2031 bp, Homo sapiens
atcaggtatcaaattgtagtggaaataatccaggcgactacaattagcagctttccccaactgaagaggcacaaaggtaagagccagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagattcttcagtttgaagatatcttggccaatacgttctaccgagagcactttggaatgtacatggaaaggatggacaaaagagctctgattagtttttgggaatctgtggaacatttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaaggcaagctctaaattctattcaaaatgcaccaaaacctgacaagaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagtgcgctggggacctctagatcgaccacagcagcagctgccgcg

SEQ ID NO: 275949 - DNA, 2219 bp, Homo sapiens
atcaggtatcaaattgtagtggaaataatccaggcgactacaattagcagctttccccaactgaagaggcacaaaggtaagagccagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagattcttcagtttgaagatatcttggccaatacgttctaccgagagcactttggaatgtacatggaaaggatggacaaaagagctctgattagtttttgggaatctgtggaacatttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatggaacttcaacaaatacgcttctgtctcctagagaccatgattgaaattttctgaaataaggcctgaactttggaatttgtaaaagatcctcgggtgattttaacatgcagagaagcttgggaaccactgctgtaatatcagagtcagccaagggactcagaagactcccccactcaggctgaacaatctgtgttccacaaacactgctctaccaagtctgctatgatgtaattctgactcgtggatgtgatggacctaagatgtgcacagctttttggtttttctttttttaaaaaaaatctaaacttaagagttagtactcataatgatctcccttacaccccctccactaccacaccccttgctttttagtatttactttgagatgtgaaacgcatttgggatctaaataaattgatcacatggatt

SEQ ID NO: 275950 - DNA, 902 bp, Homo sapiens
gcacataggatttaaggcaactcgaacctattattaactccttaaaagacatacttatctagactattttggagcctgcgattctagtactggtgagtctccaccggcagcatgactacctgaagattcgctagctatttgcaaggttggcacgccactaccacatttagttggctcctaaggtatgtcttacaccaaacttcccatatgtggaaggcacccataactgaagacacatgctctactctggatgtggggaatttgcggagcgctgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaatcacagtgctcta

SEQ ID NO: 275951 - DNA, 777 bp, Homo sapiens
attgaatagaaataaccacctatgaagtaggaggcatcttctaaattatttttacttaactcttgccacaatattatgaaatttctacttgatatcttcattgatgaaatggtgggtttaagtatcttgcctaataccacatagataggaaaagctagaacaagataaaaacccagatctgactggtttgcaaatgtgagtgctttctcactgaaccataacatctctctgactgtttttgtacttgttttagccctacctcagtacctgtcctaactctgaaggaccaaacttgtcttccaagacctggagcatactaagatagaaggaagcagccacgtgacccactcaggagcttagctgtgccgtggaaggaacaggacctcaaagcagatgccagactcctctctgtaatgtgtccattagctacaaagaggcccactggtataatgtaactcaagctacagcctctaacctcacttgttctgattttcagtctcttgattctttcctgtttagctctcggttctacttcagctactcatctgtgatgttcccctgcctccctattccagtgatcagccttgactttcttagtttctggctagtctctgttagagcctctgcaggaagggccagccccagcatacgccagggttctacagcatcttacacaagtggtgcaaatgcagctccaaggaactcttgtttttataatcctctaaccacaggaagtctgttgatgttgctattagcaaaataaaataaaataaaata

SEQ ID NO: 275952 - DNA, 526 bp, Homo sapiens
ctatgtttatgttttaatatggctttgatgctctggaagttttaattttaaagtaatttagggttcccaaacttacctgacattggaatcccacagggaacttcaacaaatacgcttctgtctcctagagaccatgattgaaattttctgaaataaggcctgaactttggaatttgtaaaagatcctcgggtgattttaacatgcagagaagcttgggaaccactgctgtaatatcagagtcagccaagggactcagaagactcccccactcaggctgaacaatctgtgttccacaaacactgctctaccaagtctgctatgatgtaattctgactcgtggatgtgatggacctaagatgtgcacagctttttggtttttctttttttaaaaaaaatctaaacttaagagttagtactcataatgatctcccttacaccccctccactaccacaccccttgctttttagtatttactttgagatgtgaaacgcatttgggatctaaataaattgatcacatggatt

SEQ ID NO: 275953 - DNA, 503 bp, Homo sapiens
atcaggtatcaaattgtagtggaaataatccaggcgactacaattagcagctttccccaactgaagaggcacaaaggtaagagccagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagctctcggttctacttcagctactcatctgtgatgttcccctgcctccctattccagtgatcagccttgactttcttagtttctggctagtctctgttagagcctctgcaggaagggccagccccagcatacgccagggttctacagcatcttacacaagtggtgcaaatgcagctccaaggaactcttgtttttataatcctctaaccacaggaagtctgttgatgttgctattagcaaaataaaataaaataaaata

SEQ ID NO: 275954 - DNA, 292 bp, Homo sapiens
agatatggtggtatgtgactctccccctagggcccaagagatgaggctggtgaggaagccgtggatgatggtaccaatcagatcaatgaacaagccagttttgctgtaaacaaactgcgagaactaaatgagaaacttgaatataaaaggcaagctctaaattctattcaaaatgcaccaaaacctgacaagaaggtaactctttgctttcaaggttgtctttgaaagttaacatttgtctaatttggtagttttcagttgaggttgagaagtgtcagtttcttttaaaata

SEQ ID NO: 275955 - DNA, 2384 bp, Homo sapiens
atcaggtatcaaattgtagtggaaataatccaggcgactacaattagcagctttccccaactgaagaggcacaaaggtaagagccagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagattcttcagtttgaagatatcttggccaatacgttctaccgagagcactttggaatgtacatggaaaggatggacaaaagagctctgattagtttttgggaatctgtggaacatttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaatcacagtgctcta

SEQ ID NO: 275956 - DNA, 229 bp, Homo sapiens
aattgatggagccaaaagaaatttagacagaacactgggtaaaagaacacctctattaccaccacctgattatcctcaaactatgaccagtgaaatgaaaaaaaaaggagtgagttcaagtttttatatttcttgtttgaaaatgttcaaagaaattattgcaaagtagtttcatctaagaccacctgctaagtcccattctagaaaataaataaatttagaaactgag

SEQ ID NO: 275957 - DNA, 604 bp, Homo sapiens
tctttctcctccctccccccggttgcactctgttatgaagaatgaatgctctggatatatctcacggtggttattcttccccttcttttgccagagccattagggaatttttcttggctcttcaccatgagaggctgatggcattcccagaggcaaaacccataagagtgtggtgcttcctcagactgcagcccccaggagtttcctgctcccgtattataatgcccacactcagcctcaaacaattaatcaatattaccattttactgttcctaccagttcatggtcccagcagcttctgttccagctaagctgatctcagctctgtctccctggatctacctgtttccccatattatgggatattggtttactttgtcatcttacttcgcagatgagtcaagaaaagtgactgacttttagttttctcagtttttccttacggaaaggatggaagtgatgaattctaaacttttttacatgtcagagctgaaactggaagtccagcattgagatttcttactctaaagtagaagaaggtatggacatggaaagagaatactatcactttctacctgagggatttggagagaaaaaatagaaa

SEQ ID NO: 275958 - DNA, 463 bp, Homo sapiens
  misc_feature (399)..(399): n is a, c, g, or t
  misc_feature (402)..(402): n is a, c, g, or t
  misc_feature (426)..(426): n is a, c, g, or t
  misc_feature (442)..(442): n is a, c, g, or t
tcaataaagcatgccccacccccccaaattttacattggttaacaaagccagtttctaacattttgctaacatttgagcctcttctatgtgcttgtgtagcaaacagctagtcacttccattagaataaagagtagaataccaaggggaatagtgcaagaaaacgttggaggattgattggggctagatttgagagggccttaactgccaacctaaaaatgttggtatttattttctagggtactaggagccatcacaataattcaattagtatagtgtgatatatttgcaatgtattttaatgatgtatagctcagattaatttcaaagcattacatattattcattgcattttactttactgatttttaaattgtttggctttggtcactgcccatntcntttaagggccccataaatgatatnaattgagtctttttanggggcctaagtgtttcctttt

SEQ ID NO: 275959 - DNA, 576 bp, Homo sapiens
acaggcgtgagacaccgcgcctggcctgatgcagctagtagttttttaatgaaccttaaattataagggaggttgttgcttttatagtaactttactgagctcaaatgaagaaattagtttcctccattttcctttagaggagtatgatataattttataatttgaaagaagggttggtattcactttttctggaattttcctttctaggtatgatttatgacctagtatcttttgagtaatgtctccttcctttctttttcatcaccagctgtccagttagaagcaagtctggtcatacctgcttttgtgtaccatgtcttacagtagtagttgtcttggggctgtctccctactcatgcccttcttgtcgactttcacctgggtcatgagaatggcttcaaaataggtcttctgcttcagatttctcttaattttcctgtacactgtttggactggcctttccaaaacacctttcaggggctttgtgatgctttcaggatcaagttcagacactaagcttggcagtccaactccttctaccttgaccttaacccccctttgcagttattttctt

SEQ ID NO: 275960 - DNA, 437 bp, Homo sapiens
ctgggtgacagagtgagactctgtcccccccaaaaaaattaaattaaattaaaaaaataaaatcagctctaactctcaactagttcctgcagcattctacttattgattttccttttaacttattatctacatatgtttacctttatggtttgtagtttatcaagtggggaagatcatagtgacacaagataaatttactgattacataatggaatattgggtgggcgcggtggctcacacctgtaatcccagcactttgggaggtcgaggcgggtggatcacctgaggtcaggagttagagaccagcctgaccaacatggtgaaccctgtctctaccaaaaatacaaaaattagtcaggcgtggtggcacgtgcctgtaattccagctgctcaggaggctgaggcaggagaactgcttaacccaccactgcactct

SEQ ID NO: 275961 - DNA, 284 bp, Homo sapiens
tattatagaaatgaatcatatagtatataacacttttgattgtttttttctgcttagcataattatctggcgattaattcaaccttttgctgtatcaacaattctttcttttatagattaacttagagagaataggtccatttaggagaggccataatgtctccatcaattagtctttttaaaagtcccatggaaatgttttgctgttttctttattgagttcttataagttttttaaaattttatttttatataacatatacaaataaatgtgttatggatct

SEQ ID NO: 275962 - DNA, 414 bp, Homo sapiens
tatttttcacaagaacccttaacccccttacttcgccacaagagggtgcacatttccttaggaatacagtaacccagggaaacctgctcaagttcctctaggcagctgctcacctctgctccggcacctctctccctagccatggcagtaatgagcatctgcacatagttacataggtgaaacgtgttcacatactttatctcattcaattccaacaacagctctgtgagggcgggttgggcaacttatcaaccccattttatagaagaggaaacacactcagaggtgaagtgacttgcccaaggtcagagagatcataatgctagagcccaaatgcaaactcacgttgtctagttcccaaatcctgtatacattttccttacctccctattaaagcataatcaaaaattcaaa

SEQ ID NO: 275963 - DNA, 562 bp, Homo sapiens
tcatatgcagagaattttatttgttaagcatactgtactcagagtcaggccaatcagaaataatataagaaaagaaaaactggttaactctttctatctatattagtctaaggagtaccagggctaacaaatcttgatagtatgctaatttgttgtgtttcaaaacttgctctttatcctgttgcgaaagctgaattcaatagaaaaatgattatatttttaaaataaatgaattacatgagcccacagcactgattttaaagtaggacttgcattgatacagtttattgaataaagcaaaaatttttacaagtattttataagtttaaatagcaaattgaaattgtgcgaaaataatgattttgtgattattaaacattcattgttttaagagtgcatgtaacaaaaagtatctgtagttacctaacactataatagttaaaatacctgttaatatgtataagttaactctacatttttgtaaaagtttacaacattgtcattgttgtgttcatttatttattttaaacttccttttttagtaaaaatgtaaggccattta

SEQ ID NO: 275964 - DNA, 630 bp, Homo sapiens
ggggggatttattctgtctccagaagcagcatttcactttcctgaacatcagctcttctcccctggattgcagggtctaggtcttgttctctgtctgcttccagcttttggcattttgacagcacataggacatgcttggagaacgttttcttgagttaactgaattcaggacactgacttggggctggaaaggcaaagtgaggaagaaagtattcccctttcagaagctccccagtctgccttaagaaacaaaggcagccctgtcatctgcccaggactttacagtttataaagtgatttctcatcctttctcctttcttgtattgcacaaatatcgaacgagaacctgcagtgtgccactgtgcagggtgcctagaataaaggagaaaagccactgtgctttctctgaaggaatcacagggagtgaagctagcttcatggatgccagaatttcacagatgaagggactggaggcttggagcaattgcattgcttgagatcccccctgctcatggatggtggctcccaaatcaggacatgagtcttctgaatcccttaaacctgccctgtgcctgcctgttctcccagcacattctctgtactctcttgtgctgctcctcaccccctct

SEQ ID NO: 275965 - DNA, 571 bp, Homo sapiens
gtgttgtgcctgaaccttatctacgaattatggtcccaagtgggtactggtgcaggtcaccctcagctctgtggtccctctgagaatacctgctggcaagtaggcaggactggtgagctgagcgtcacaaccgccaatgtcactgagcactccctatgagggagcaagaggtcaagcatttcaaccaccccagtgtagagagaggaggaaagagagctctgagaggttaggtgactagcccgaggtcacacagcttgcatgtgggaggctgggcctcgaggactctctgacctcccctttctcctctggagcaggccatgagatcatcctatgagaggcgccttccctatacccagagggaaggggcaaactcatctctgaagatggcatgtccccctagtttcctgccccaggctcactcccctgtccgtcgcacttcccacgcctctccactcttcttccaacctggcatcagcacactcagtggactggatctctgggccttcgtttccttacgaaggtacccatgtcatgtgcaacttctagtaaataaactggtatgtttttctct

SEQ ID NO: 275966 - DNA, 552 bp, Homo sapiens
aatcagtacagaaaaagtgatttcaatggggcatccgtaaaggaaaacaattaacttttcaatgaacaacgaacttttttttgacttgttagttgtatttgtatcaaaaaacacaatcttaatcatcatcacgggtatctactactttctatttgtgtagcattttatatagtcaacattttcacaagcattttcaattagttacaaataccttgtaaggtagaaacaaggcctcactgtttaaaacaaggaagctgaggtttcaggccagtagggccagaactcaaatcatctggttcttcatccagtgtttttcaatattccacactgccttggtgaagtctccttagtactttcccaggcatcactaaaaggagtttaaatttcttttttctggagcatgtaggaaaaggataaacagttggctttttttatttttagatcaattcaaaagactacttcttggaaacagacctacagatagacattttggacctttcctatgcatggttttcacgaagctaaatagaacacctcctcctccatcaacac

SEQ ID NO: 275967 - DNA, 4648 bp, Homo sapiens
agttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtatacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatgggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagc

SEQ ID NO: 275968 - DNA, 810 bp, Homo sapiens
gggaagaggtatctcaccgacttctgcccttccatctcaaacaaagacacacacacactctctctctctctctctctctctctctctctgtctctctgtctctctctctttctggcatttgtccccagagagtgcctagagacttcacagccttggccctggaaacccctagacagccgctatgttgccaggcacggctctgggcactgaggctacagcaatgaaaaaatcagccaagttctctgccttcatggtgctcacattctaggcagagaaagacagatgatcaacaagtgaaaaaatcataaagctcaggtcatggtgtggcaagtattagagtggagagcgatggggtggggtgggggcgctgttttatatggggtggtccaaaaatatcttggtgaggtggtgacatttgagtggaaacctggacagcaagaagctagtcgtgctttggggtcaaaaggactccaaaatttcagttttttaaatggaaaacatgtgtttacccataaacattaaagagcagggaaattagaaaaaaactcgtgtccactgtgacccctgttcccatgctgatctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgaaagagcaaataaagacctgagaaccttcc

SEQ ID NO: 275969 - DNA, 911 bp, Homo sapiens
gagtgggcctgcattctgcggaggttgttgaggaaggagggagtagatggagggctcttttcaccagaagacccccaggcacaagcagcccaccttactgatggtcagagcatccagaagaagtggcaagacttcagctgtcctcaaagcaggaagacagagtgtttctggcagaaagaacagcacaagcaaagatctggtaaccctaggtgcctccagtttgagggaggagagaggacaccccctccaccccagacataggaaagcccctagacagccgctatgttgccaggcacggctctgggcactgaggctacagcaatgaaaaaatcagccaagttctctgccttcatggtgctcacattctaggcagagaaagacagatgatcaacaagtgaaaaaatcataaagctcaggtcatggtgtggcaagtattagagtggagagcgatggggtggggtgggggcgctgttttatatggggtggtccaaaaatatcttggtgaggtggtgacatttgagtggaaacctggacagcaagaagctagtcgtgctttggggtcaaaaggactccaaaatttcagttttttaaatggaaaacatgtgtttacccataaacattaaagagcagggaaattagaaaaaaactcgtgtccactgtgacccctgttcccatgctgatctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgaaagagcaaataaagacctgagaaccttcc

SEQ ID NO: 275970 - DNA, 1645 bp, Homo sapiens
gagtgggcctgcattctgcggaggttgttgaggaaggagggagtagatggagggctcttttcaccagaagacccccaggcacaagcagcccaccttactgatggtcagagcatccagaagaagtggcaagacttcagctgtcctcaaagcaggaagacagagtgtttctggcagaaagaacagcacaagcaaagatctggtaaccctaggtgcctccagtttgagggaggagagaggacaccccctccaccccagacataggaaagctccacctgcgcaccaggggcaggacacgtggctgggtgcagacgctggcccggatgtcgcggaggactcgcgggccggtagagcgcgcggcggcggcggcggcggcggcggcgggaggagacgcaggtcacgcccccttcccaccacctcccgccgccgacggggcgcgcgcgccgaggagcccgggacaggtgactcctagaggactgcgtctgcgcctcccccggcgggagtcccttcttcgcggcctctgccgccccctgcgtcccctcctgggcttccgagagtctgactcagccaagccggcatcgcttcgcctcctacaacacaccccgagcgcgagaagaaattacaggattgcaggggcacggctaatgcgctctaattacccaccgccgctgtcatccgcggcgctccgcggcgctgggccaacgcgccgtaattaagacgccgctccccggtcccggaaccctcccttcgccaccctccacccacccacctcgcggtccccaggaccactggctgccaactcctgccgccctctgggactgcccctcagtcccaggagagctatgaggcctcactgggggcagaacttggggagaccgaagccggcccttccactcccctaaacctacagtcctggaaggtctctgctggaagagactgggagagtggggaggggccagggacctatttcgttgacagaaacagtgaggtctattggaaagttagccttcagtgggaggagtggcaaaggcacgcagggcagcagtacccccgtttggcacttgaggcacggagaagggaagggaagtccgcccagccagaactcccagacccgctcgtttaacagtggctttatgagcagcacgacggactccctcccctggcggggaaattaccttcctgcgaagaaaggtgacatccccgccacagacacggaggccccgcctgctggccagctgtggccgccataggggagctggtgaggagtgaggtggctctggcctcccatgtcaggtagggtgagagaggccctgaagatagaagccaggcccgaaggccagaattaaaggggtagcttggccatcagctccttcccccaaaaccaggctcagagctctcctctatcagcaattctttcctgaggtccagggtgttgcaaactcatggccttgggccacgttttaccttcagtgaggttttgtttggcttgcaatgagtacatgggttttaggttgaatgtgagagtctgcagacaatgtgggttctccgactgccctcccagtgaaggtggacctctgatttagaccggcccgctgggcccgtgcctacatccttttcctcagcgtcaggatcttagtccccatgattg

SEQ ID NO: 275971 - DNA, 337 bp, Homo sapiens
gaaatgtgatctctgcctctcatgtcagccctctatgaatatgctgcctggaccacatttgggattagtacataggctgaaagatcccattaagtcctgcctcttgagaatggattctggcagtagtgatgtggataatggactttccatgcttattaaacgtggcattgcatgtacacttgagacagcccaaaaaggcaggagattcacataggatagctggtgccttgtctttcttcttagggcttcccagctccagccctttctaaggctttatggactctgttgtcccagaccagacaccatcatcttttgttcctgggtttgaccacggcgc

SEQ ID NO: 275972 - DNA, 793 bp, Homo sapiens
agtgatgtgacacttttgggtagaagctggaagagtcaacgtgctgctcaccagtttcccgtcccaccctcgagtagctatggaagtttgtatcaacctagagcttcatcagtctggatagttatctaaagagcagccttgttatctgtatctcttctagacaaacagcactacactgagtcttaagagttgtttcttctgaccaaggtattcccttccattgttatattccagtcgctttgctccaccaaactcttggtcatattatatattaaaatatgttctttattattcctgttcagtgaattgtctgagattttaagtacaatttttgattttgggggaattaaaacttattctttttacattgtctcacagttttcagagatcatttttttaaagaaaaattactgcattcattttggtggcttaaaacaagatgtaatttagagaatcattttatgttttcaaataaaacctcctacatttaattgactaaaagtttaagcacaagttactacacaaagaaaaccttttttagggttatgtgaacttgaaataataccattaagttttcagctgtctgaagtagcacagcaacattaacgggaagggactaaacaccacttctgctcctaaaccaacaagagctgagacatacaaattttatggcaagtaatctaaaactcttctaaaaatgattaactgttattctatccaacaagaaaaccaatacaacagatctatctaattagttaagacaccagatacttgtcatgcagtttcagtgtct

SEQ ID NO: 275973 - DNA, 871 bp, Homo sapiens
ctgggaaattcttatagtttgtaaagctccttggatgattttaatacacatttagataaaaatcctagttttgtgacatgtgcctgtagtcccagctactcgggaagatgaagtgggagaatggcctgagccagggaggtggaagttgcagtgaaccaagaccgtgccactgtactccagcctggttgatagagtgagaccctgtctcaaaaaagaaaaaaaaaaatcctgattttgggtaccatccttctcactgtaatcatgtccactaaggacaatttaaccataatcatttgtaatgaagacaataaagaccgctatgcttttaacttttatgagtattttaggccacgagtcgatggcatctttctctaagtacattgtactctggtttccttaatggtattttaggaaacgctagcactattccttgatctggcttctaagaattaagatggtagggctgggctactttcccccataatccacattgctttcacttaatcaaccaattctccctctacaggtaataagttttggaatagcagtgttcataacccattttcttcttcctgagtaggaaatgacaaatgtaccagaaatccctgttggagtattttagcacatttcttagtagatacagtctagttttgcctctctgcacttggtcttcaactatttacttacgtccacttgactagacagcctgtagttcaccttaacaataatctccctctccttttgtccttacagttatctaaagagcagccttgttatctgtatctcttctagacaaacagcactacactgagtcttaagagttgtttcttctgaccaaggtattcccttccattgttatattccagtcgct

SEQ ID NO: 275974 - DNA, 507 bp, Homo sapiens
tacttttcacagggctatgcaaccacagcagttttagaacatcttcatcaccccagaaagaaaccctgtagggaggtatggctaaggttgagaatgttttcatgtgaggaattttccatttaggaaacttattagctgtttttcttttttttttaatgtgtagatttgaagtggagggaaagggacatgaaggtgtgagagaaagctgtagcttattctgacacttcatttttggtatggcttgttgccattctatctttcactgtgtaacatagtccccaaaggtttttgtttgtttttttgattttttttttgtgtgttggggaggaggttttattgagatttaatacacataccgtacaattcactgatttaaaatgtacaattcagaggtttttagcctattcacagggctatgcaaccacagcagttttagaacatcttcatcaccccagaaagaaaccctgtaccatttagctgtcattttccctcacctccctgcttttc

SEQ ID NO: 275975 - DNA, 208 bp, Homo sapiens
gaaggatgcctctgccgctgtgttcaccatttacctttctttgggtaggagtccagtgccatgtcccctgtgagcctgcaccctttactttgtaagaagacaccgaagtgtgctgggcgtagtggctcatgcctgtaatcccagcactttaggaggctgaggtggggaggatcacttgagcccaggagtttgagaccagcctgggaaa

SEQ ID NO: 275976 - DNA, 300 bp, Homo sapiens
aatattaataattgaccttggctgtatattaaaatagttacttttatagtagagcacatttctcaaacatgccctgaaaggcttttatcaagctcatataaagttaaagctttgagctaccttttcttggccaataaagtcactgacagtttatgtaaacattaatttcaacatggctgttgcattttaattatcaaagatgtttaagatgctttaagatgacacatagagacatacacatacatacacattagtgcatttgtaatttgttaaattgaatgactatacctgagtatagtc

SEQ ID NO: 275977 - DNA, 357 bp, Homo sapiens
acaaaatggtgttagaacatattgttataccagatatcaaggagattataaaagactgccagggtcatgtccaaatgactcagtagccaatgtgaaaagatttgtttttcaaaaggtagagacatgactagaggactcatccaatggtattataggttatattgaaaaggaatgacgttgtgctatgtgtactgcccttagaagagctctaggatacactgcgaaatccttaaaaagggctaggcatggtggttcatgcctataatcccagtgctttgggagtctgaggaaggaagattccttgaggccagtaggtcaagaccagcctgggcaacatagtgagaccttatctctaca

SEQ ID NO: 275978 - DNA, 412 bp, Homo sapiens
atgaccttagtgctcttagtatacaaatggtctaacatacagtaggagctcacaggtgacggctgaactctactgtccacttgaacacacctgggtcctattcctggagatctgggcttgtgatgcggctcagggcccctgtcctgccacgagtggcacatagcaaacacgtgcatgtgtggctttggcacagagggtctcactcctgcatttagcccctctctgattcacgtcctgggcccgaaacctcccctggggaagcgggatagtcacagggagaagcatggggactgtcactgccgaagcccacagcaaaagaggattaccatatggttccacctgggctagccactcaaagccttctagaaacacagttctaggaatgcatttattaaacacagtccatttttct

SEQ ID NO: 275979 - DNA, 493 bp, Homo sapiens
tcataccaagcatcttctcagaccacagtggaaaaaaaacagaaatcaacagcaagaggaattcttaaaaccacacaaatacaggaaactaatcaacttgtttctgaatgactctaaaataaacaaaaaattaaggcagaagtcaaactgttatttgaaacaaacaaaaatagagatacaacataccaaaacctctagagtacagcaatggcagcgttaagaggaaagtttctagcactgaatgtctacatcaagaagatacatctgaaattaacaacctaaaatcgcacctaaaaaaaaaaaaaaaacagaaaaacaagaacaaaactaaacctagagctagcagaaaaaaaagaaataactaaaatcagaacagaattaaatgaaattgagacccataacaactatacaaaggatatacaaaatgagaagtttgttcttggaaaggataaaaaaagattgatatactgctagctagattaacaagaaaaga

SEQ ID NO: 275980 - DNA, 299 bp, Homo sapiens
gcataacaataaaaagcatctacaaatatttctaaggcacagacactaagaagataattaacgtgaaggaaaaggaatactagagatgtgacggaataaaatcaaacaaggatggaatctatccacatcaactgcccccatccctttctatgtcaaaaaataaccacgctgagatcagaataaaggactctttgtttccatctgcagaagataaaccatcacgcatctgaggctgagttttggagctgccactctcttcctgtttccctgcttgagggtccaattaaaatttaacaaaa

SEQ ID NO: 275981 - DNA, 273 bp, Homo sapiens
ccttacttagttaactcctcttgcttcagatatctcaggtcaattgtcccttcctctgggaagcctctggtggcctctctgactaggtcacacttccctgttttacattctctcaaagataatgtacctctctctccatcaccgtacttatcacagctacaatctacattttctgtgtgttattttgcctcaccactgtactcctagcactcaggaaaccttcaactaattgctgaatgaacaaatgagctgcccatggaaagctagtagagc

SEQ ID NO: 275982 - DNA, 352 bp, Homo sapiens
catcagctgtgagtcagtggggagtgtctgaggatggaggcgctatggctccctggagatctcttggtgtgtccacatgccgggtgggtccacggacaggagctcttctggtgcttccctcactccccacccgacccatgcagtacccaccctctgcagctgggccctccagctggctcagctcagccctgtttcatgtttagtcggtctttgatcttcactctttaactaaagccagagccaggtgaaacctgattttatccttttctcaaatgtgaactaagctcaaaagaaagagaaggctgatatggacccacatctaaactcacatctgaaataaaaacttgagtgg

SEQ ID NO: 275983 - DNA, 301 bp, Homo sapiens
tcattattcttaaaagctagcttgtccacatctgaaaattcacttttgtccttgaagttcagtttggtcttcgataaagacccactttctgctccggagggctggagagatcaggggggagctgatgccaagaccacgaaattcaatctgagcatcagttcttccagcacagcacatcctgtggaagcagggaacagaggcccagagaaggggagtaacttgtccagggacacacagccttgtagtaggggatggtccaggcccttggaggagcagggcacagggccagcatccctgaggt

SEQ ID NO: 275984 - DNA, 435 bp, Homo sapiens
tgccaggccatctacctcaaacttttttcctatttaatccatgtaataggtaccaaatcctacacaacttaaggctaaaaaataagtttgcttatgagtccctatatacaaggtaaaatagagattgttctatggactagcttatggctgcaaactacattttaagaaaagcataaccaggccgggcgcagtggttcatgcctgtaatcccagcactttgggaggccaaggcaggcggatcacctggggtcaggagtttgagaccagtctgaccaacatggagaaaccctgtctctactaaaaatacaaaaattagccgggtgtggtggcacttgctggtagtcccagctacccgggaggctgagacaggagaatcacttgaatccaggaggcagaggttgcagcaagccaagattgtgtcactgcactccagcc

SEQ ID NO: 275985 - DNA, 255 bp, Homo sapiens
  misc_feature (246)..(246): n is a, c, g, or t
  misc_feature (252)..(252): n is a, c, g, or t
  misc_feature (255)..(255): n is a, c, g, or t
aaccttccatggaattaggctttcacagagcacactgtgggaaacacagctctcatgtgcgatcagcaaaccaacctgtattagggtgtccacggagcactgttttactctgtgcatataactgaggtggaaatctacgtcacaagagaatctgaagttcccgagagaacaagccatatcctgtctgcttgtcatctgactcataggctcagcaaacactgcttgctaacttgataaatatatgtnaacccntcn

SEQ ID NO: 275986 - DNA, 539 bp, Homo sapiens
cttgccttacatttaatcttcactattaatacacacatgttataaatgagagcatcaaagtatggagagcagaagcaacttgtccaaggtcatacgcaactagaaaggagtgtaactgatatttaaaccctaacagtctggttccagaatctgtgcttttaaagtcaagatgaaaagcatgtctgggccttgacccttggaacccacccctaccacacaggctttagctagcagaggggcagcaaaggaagacagcaagaggtggcctctggtcgtagctctttgtggtttgccaaggctttctggttcactgactcaaaagggtttggggctttacagactggtaagatctcccaaactgggtagttgtactttaattttgttaagtaaaaacatttttaaaaatctgctaacatcactatcatttcataaagtaaatgtaatttcaatgcaaataaaccccaagaaagacacaatctcagagtacagtccaggcctttaggttgaataaatctacctttgtaaacacctcctttcgt

SEQ ID NO: 275987 - DNA, 406 bp, Homo sapiens
acagattttttttgttaagtgtttttgtggcaggggctgggggaagttgatggttgtatttaaaccacagatagctctcatatattggtctgaggagagaaataaataactagaatgctacagttttaaagactgtaaaactaatatgtaaggtgatttacaagtgaatggaggtcaaaagaattgcatgctttcagcacacacagagttaaccttgcagtatctccttgttttgccagcctgctgttacctcatgaagttaacaggactgatcttttaaaaactcctacacagggctggatatgttggcttatgcctgtaatcccagcactttgggagggagcaggaagatcacttgagccgaggagtttgaaatcagcctgggcaacagggagaccccatttct

SEQ ID NO: 275988 - DNA, 364 bp, Homo sapiens
agaaaatattagttcactgagctatctatatcttctagttgttaacacattatacactatcaaaacctctcattcttggccagccacgatggctcatgcctgcaatcccagcactttgggaggccaaggcgggcagatcacccgaggtcagtagttcaagactaccctggccaacatggtgaaaccccatctctactaaaaatatcaaaattagccaggtgtggtggcagacgcccatagttccagctactcaggaggctgaggcaggagaatcgcttgaacccaggtggcggaggttgcagtgacccaagatggcaccattgcactccagcctgggtgacaagagcgaaactgtcacaaaaaa

SEQ ID NO: 275989 - DNA, 721 bp, Homo sapiens
aggcagctataacagaatgttttagactgggtggcttataaataaaattccagagaattttatttctctggaggcccagaagttcaagaccaagatgccgtagatttggtgtctggtgacagcctgctttttgattcatagatggtgccttctaactgggtcctcccatgttggaaggggcaaacaagcgcccttgggtctcttaactaatctcattcaggaggattctgcccccaggacctaataatctcacaaaggcaccactttttgataccatcatcttgggggtgaggatttcaacctacaaatttcagggggatacaaacattcagacccttcattatatttggttaaaatgctgttaaaaaaaaaaaaaggttactgtatgatgggagtgtgatagaaacagaaagcccatcggctgtgaaaccagagtttttaatcatttctgtcatttcctgggtgtctctggtagcatccttaaactagggtggtgaagtatggcttatggcttatgcctgggctctcagaggaattgtgtgcttggcttccctagggcctgtgagcctggggcaggacgtgggtggtatgagagtttggacttaggccggcagctggtagggaacatctatccttgcactcctgagatcattcccctgccagagaagacacagctcctgttttggtctgatgaattaagctaattgtggtgcttaaactt

SEQ ID NO: 275990 - DNA, 461 bp, Homo sapiens
aactcaaggctaagggctatctatccctttatcttttcttttttctcttagtgcctagtacagtgattgccacacaattgacatgcaatactgaacaatgacataactatcatttctggttggcttttttaactgctagtttatttggatgttcttttatatttatttcataagaatccagggatctgatcctctgttttttgcctttgttttccctgaggttagatttagtttttataaaggcaacattttgtttttgactataaaatgctgccaaatatacagcatgcattctgctcccactctgtccttggaagacactgatcatcggtcaaaatattcttccctgagaagccacgtaggttcttaacccttctcaacacagcacatcaaatagatagctgctatcagctgaaagtaactggtagctgatgtgaaatctctttggaataacacataga

SEQ ID NO: 275991 - DNA, 448 bp, Homo sapiens
aatgacagtgatgacaaacaaaaagatgatcaacattattaatcactaggggaatgcaaattaaaatcttaaggaaatatcactatttattggaacatttaaaataaaaataaagataagaaaaccaaaccatgttctggtaaggatgaacaacccaacgctcatatgtttttgatgagccactttggaaaacagattagcactttatgttataaattagcacttacgttataaattcatacgtgcacttattgtatgactgaggaattccatttccaggtttttaccaaggaaaataaaaatgtatgtctgtacagtatctgtacatgaatgtttatagcaattttatatggaacaaccccaaactgaaaacaactgtagtgtccattaattggtaaataaataaactcactggggcatatccataaaatgaaatactatttaacca

SEQ ID NO: 275992 - DNA, 469 bp, Homo sapiens
ttcccaaactactttgtgagactggattttttcatatatttcaatgaaaacaatgtattgtaacaatgcaaagcagataggaaaattcagttgttttctattaagacagacattaaagagatttgcaaaaatgtaaaacagtgctactcttaataaatattctttcctttagaaaatttattttgaggccaggcacggtggctcacacctgtaatcccaaccctttgggaggctgaggcgggcggatcatgaggtcaacagttcaagaccagcgtggccaacatggtgaagccctgtctctactaaaaatacaaaaattagccaggcgtggtggcaggcgcctgtaatcccagctacttgggaaactgagccaggagaatcacttgaacccgggaggcggaggttgcagtgagccgagacagtgccattgcactcccgcctgggcaacaaagcgagacttcgtctcaaa

SEQ ID NO: 275993 - DNA, 316 bp, Homo sapiens
gtgagctagtagagtgagaactcattcattactgaaaggacagcaccaagccattcatgtgggatctgatcctatgaccctaataccgcccaccaggcccacttccaacagtggggttcaaattttaacatgagattcacaagggacaaaactgccaagctatgtcacatgattttccaaacaaataattgactgatgaattaaagatgagatagttatagttgagactaaagtttgagaactagaagttcaagtggacaaaatatttcaaacagaacataattataaagagatggatataatgaggaaaaaatca

SEQ ID NO: 275994 - DNA, 465 bp, Homo sapiens
tagatcgcgccattgcactccagcctgggcaacaagagcgaaactccatcccaaaaaacaaaaacaagacaaaattagccgggcttggtggcacgtgcctgtggtcccagctactccaggggctggctgcagcgggagaatcacctgagccggggagttcgagtctgcagtgatccgtgattgtgccactacactccagcctgggcgacggcagtgagacacttctcaaaacaaaaaagagaaacagtcatccaaccagttacacaaggcctctgcaagacacaacacagtgttagagatagtgaaagatagttctatgttttggaggagtttatttcctcccaattcgtgttttgtgtagaagcaccgttgtctgcggttagcctacggactactgtcaaagccaagaatctgagataggttagattattagcacgggtgaaagttttatttcagacatggagt

SEQ ID NO: 275995 - DNA, 675 bp, Homo sapiens
gaaaaatgaaacatcattacaaagccaacagacattgaaaagatgagaatattatttaaaatatatattatgtgataatttagataaaacaatcacctaaaaaaatacgacttaaccaaagctgacagacacacaaaaaacacaatagaaacaaaacaaaataatcccagtgtttaaagagccatagctcacgtttaccagctctttacaatgaaagatagaacatcatgggaaattgtgcattatgtcagtacaaaggacttaatagaggcttgttagaggattttggcttgtgttaggcgatttataaataattcaagaaaaatgtacttttcctgggaattgggtgtgatcagaaagagcaaacaatggtttagtatcttaatttttatgtatatgtaagagaaatggagtgggactaaactatcattggtaaagaagcaggagtcactcatattaactgggagaagagaatgtttggttatttttgtgttatggaaagtgttcctgttttttgtgctcaaacatgactgcagtcagagtgacctctctgatgttggtgttttatgaaatgatttatgttcaacaggagtacacaaagtccaagctattagaatctggccagatctcagtctagagtagtcaggtgctgctttttttctttctcatttactc

SEQ ID NO: 275996 - DNA, 405 bp, Homo sapiens
atgtgctgggtttgccccagtgggggtgcagctgggaggtgacagaaggaaccctccccatgagtgagggcccagtcaggctgcccatcctgggccccggaggcagcaagggaagggcccaccagccatgctgaatgtttcacagagctgaaggaaatcatccatgcaaccctgatacggtcacacaaagtcgcccaaaatttgagcctttgactgacagactgtgatggaaatgttatctcctgctgattaagagctctgattagcagtcatatctcatccactaacacggagaaatgggttaaacctttattttacaaatcagatttgatacacaaaatatttttaaaacatggttcctggaggctctaataaataaaggaataggtgatgttgaaaaggtta

SEQ ID NO: 275997 - DNA, 199 bp, Homo sapiens
attacaggcacccaacactacacctggctaatttttgtatttttagtagagatggggtttcaccatattgggcaggctggtctcgaattcctgacctcaggtgattcacctgcctcggccccccaaagtgctggtgtgagcgagcgcgcctggcctcacattgactattatttactgaatgtcataaatggtctttctt

SEQ ID NO: 275998 - DNA, 153 bp, Homo sapiens
acatacatgcacacacccactcatgcacgtacacactacacacgcatacacactacacgtgcatccacaccagtatcagagtgctctatgggaagatagggacactggctatgtatttatttggattgattgagatagggtctcactgtgttg

SEQ ID NO: 275999 - DNA, 506 bp, Homo sapiens
caaaacaaatatctttccgcttctacacatacgcccctatcgtactagtctcttcttccctagtgtcaggaatcatgagtaattggcttacaatacaaaggaaaaaagaaaaccttgggggatactcttattactagaactgtttaaatggatttataggggacgtttaatgagagcagaaattgaaattgcacttgactgcatttcagggcagcagatttttatttagcagccagaaggggtgcaagatatgttaaagaataacgaaaaaatgtaaacctgcccgtagggagcttaaaatctgattaacttagccacgctaatgatagagcaagaaaagctggctgagcaaagaacactgttcagatgccaccgggaaaaatataacagactatcgaaaagtctacatttgttacagctaaaaggtaaatgtttaaattaaaacaattatttcattataaatgcaatgtatggccattgaagaaaaaaatgataaaattagcaaa

SEQ ID NO: 276000 - DNA, 436 bp, Homo sapiens
taaaattggagccactcttgaaaaattgctgcatgccccactgaatgctagagcaagacatgcagtcccagctccaggggcttccagagtgattgaggcagggctgtgggctgctttcctgaagcctgactcctttctttcctcattacactgccacagatggtggcagatacagcatggattggcataagtcactctctactacctgcagaataaaggcccaatttcctagtgcagcttgcaaagtccttctcatctgccaccttcctgcctttgtgatttctcctcctgggactcctgcacccccttttttttttttaatttttcttttcttttttttgagatagggtctccatctgttgcccaggctggagtgtggtggcgcgatcatagcttattgcaggcttgacctcctgggctcatatgatcctcttgc

SEQ ID NO: 276001 - DNA, 538 bp, Homo sapiens
ttagctgaatgtggtggtgtgtgcttgtagtcccagctcctcaggaggctgagatgggaagatcacttgagcccgggaagtcagggctgcagtgagccaagattgtgcctctgcactccaatctgggcgacacagcaagaccctattaaaaaaaaagaaaaaaagatcagttgaccacatgaccatacatgcatgggtttatttctgagttctctatcctgttttattggtctgtgtgtctatgtttaagttgtacatgcaaaacagtatggtacataatgttttgattactgtaactttgaatgtagtttgaaatcagcaaaggtgatgcctccagttttgttctttatcaagattatttattctatttgtagtcttttgttgtcctgtactaattttaggacttttttctacatctatgaaaaatgccatggaattttcatagggattgaattgaatgtgtagatcactttgggtaacatggacattttaatattattaattcttccaatccataaacatgggatgtatttccagc

SEQ ID NO: 276002 - DNA, 498 bp, Homo sapiens
tctctcctaatacttcctgtgtgggcctttatgttggaacatgaaagcagctgacaatgtaaagagaaagaaaacccttaagattgaacatagttactggtgtcccacacataaaccgtgcagttgggagtagcctctgggggccatttccagggaaagcctcacctggagaggtcagaacctcaggattttaaaagcaaggggcatgcttcattacaatgtgggctggaggtgagcaaacatcccatcactctgtagagaggctgtttcaaggctcacccaagtgttcagacataaatacacaagcaggaggccctttagaaagagttcagacaagttatatactacctgaatgtgagccaggccaaactgctcgggcctgaattaaaaggaaacagtttataggctgtagggccacttaccaatccatctttttcactggggagaaaaaaaatcccttttgcagaggtgatgaaaacctgtattaaaaggtgacac

SEQ ID NO: 276003 - DNA, 422 bp, Homo sapiens
  misc_feature (184)..(184): n is a, c, g, or t
aacagtcacttttcctgcacctgagaaggtaaaaatcaaactgccttagaaagattctgtcctcctaaaaactggtgcctctgtacacctcaaggagtcagcaggctctccctccgaggcttaaaagcctcagggatttctttttttctttttttctttttttttttttgagacggagctcgcntctgtcacccaggctggagtgcagtggcgcggtcttggctcactgcaacctctgcctgccgggttcaagtgattctcctgcctcagccacctgtgagccaccgtgccagccagcctcagtgatttcttaggagcctgttgtatgcaatcttgagggctgaagaagtgagagggacccaccccatcctacctctacagaatgcttggcacccccaccaatgttcctagactccatctca

SEQ ID NO: 276004 - DNA, 2656 bp, Homo sapiens
cacgcgtcgatcttcctcatctgaggaggatgatgccctcagacaccatgacgacctcccttcaaacgtggcgtcgtgggttgtttgcgcctcgcctggggtcagcgagcaaggacgggcgcgggcggggatactcaaagccaacagctggagtcagccctcgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctgggggggaaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggttgagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacacttaagtagattttaagaataaatgtttctggaaaagaactatgttatgattttgtagaaatgtaaagattacttgaggtgtttaaaataaatttttcattcagacta

SEQ ID NO: 276005 - DNA, 3043 bp, Homo sapiens
cacgcgtcgatcttcctcatctgaggaggatgatgccctcagacaccatgacgacctcccttcaaacgtggcgtcgtgggttgtttgcgcctcgcctggggtcagcgagcaaggacgggcgcgggcggggatactcaaagccaacagctggagtcagccctcgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctgggggggaaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggttgagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacacttaagtagattttaagaataaatgtttctggaaaagaactatgttatgattttgtagaaatgtaaagattacttgaggtgtttaaaataaatttttcattcagactacctttgactttttgaggtgtttttatatttaacattttgccaattcagtagttggaacaaaaatcctctgctccgacaacaagaattcagcctcatgcaaaataccttgcatcaacttaagaaacacttaagttgcctatgtaggagcatttatgccattggattggtagactggtgaaaacatgggttaaaaaaaaatcatcactagaagaggaaggatgaaaatgatttttaagagcctctgctgacataagtgttttccaatactttaactcattttaccagttcaaagcacattctctgatagcacaaaggtgataaagctaaaattttaaatagaatatcccatggattttaacattaagacatttatgatgttagttgaga

SEQ ID NO: 276006 - DNA, 1503 bp, Homo sapiens
cacgcgtcgatcttcctcatctgaggaggatgatgccctcagacaccatgacgacctcccttcaaacgtggcgtcgtgggttgtttgcgcctcgcctggggtcagcgagcaaggacgggcgcgggcggggatactcaaagccaacagctggagtcagccctcgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgccc

SEQ ID NO: 276007 - DNA, 397 bp, Homo sapiens
agcatgactttccaagtctaactgtgcgtcagaatcatgcaggaggtgttttatttcttggcctagttctgaagacatcaagagttgggcaggtgagatgtgtgtgttaagaaagcactctgggccgggcatggtggctcacgcctgtaatcccagcactttgggaggccgaggcaggtggatcacttgaggtcaggagttcgagatcaacctggccaccatggtgaaaccctgtctctactaaaagtagaataattagcctggtatggtggtgcatgcctgtaatctcagctactcgggaggcaagagaatcccttgaacctcggaggctgaggttgcagtgagccgagatcacgccactgcactccagcctgggcaaaagagcgagactccgtcc

SEQ ID NO: 276008 - DNA, 395 bp, Homo sapiens
tggcctgctggcctcagggagacgagtctggagaacttcagtgctgagttatgcaggactggccctctgtgctgtagtccagagaagagctggaagagctgaggcctgaaaatctgcaataagactgaccacaccccacgttgaaagcctctccccttccctccctgtccactggatttgaaagcacgagagcattctatttttcctcttagggacccacctggagtggcccttgcagggtcatctccccaacatggccttcggaaggacattggatgcaggacccaagaattgccagttcattgtttggttttgggcactggcaaatttgtcatggactttagaggctagtgtttgagagtggccctagaagagggtaagtgcaatggttcata

SEQ ID NO: 276009 - DNA, 391 bp, Homo sapiens
gcttgcctaacagttccttagtgtgatgaagcagttagttgaagagttgatattttaaaataaaagagctatttaaatgtttataaaagttaccaaatcaacagtgtcaaattattgaactcagagaaatagtataaagtatctctgtcagcattgaaattgctgtatctgtcacacaaggtctagaaattgctgaagaaaaaaataataacttaaaaaaatgtataatttcttcctggccacattgactacaaaccagaccagcaaacaaaagaataatctgttagtagttcaaggatgcttggacagtttgtttttcttatatgattcagccagtcctacgcgaaatgtaaacatttaaaaatttaactccttaaacttgcttgaagct

SEQ ID NO: 276010 - DNA, 426 bp, Homo sapiens
tcaaattgactgtatcatggaccaatggatctgggagggaccctcagtgtcccctagtttaatacccctgtaatacaaagaaggtacctgacatccagagaaatgatgtgccttgtgtaaagttgtggttaggaagggacagagccaggactctaaattctgtcctccggccataattccaaaactttctccaatgttaggtatgtaggctaaaatgtgctaacagcacttgtgtttttgtttccttttgttttactttttattatggcaaatttcaaacatatacagatacagaatagtttaatgaactcccatgttctcatcatgccagttcaaacatgaatacatggtcaaccttgtatcacttaaactcctgcagacaagccctgccccatcctgttgttttgaataaaatccatcattgta

SEQ ID NO: 276011 - DNA, 370 bp, Homo sapiens
atcagtgaaatctctattctctgctctgttcagagcctttcttcacccccgactcttaaacaaaacatggctgcctcctgagaactctgctgcttctttaaccctttcaagcgatggtggctgttttttttgctgccacataccactgggcctgggggtggggtggatgtcttccttgatcacatttatggcttccagaccacctttccctgccaagggtgactggggaaattagtagataattgcaacagaggacaagcagcagcctcaaaggagttgaggctttttggaaaagggggaaaggtttcagcacctggtttactgattttctctctaccataactcttgctgtcattcttaacatccatat

SEQ ID NO: 276012 - DNA, 508 bp, Homo sapiens
tcagccccaagcagcaatatcacagtccccagtgagctgtccacacatggctgagagctcatgaagcagcctctagctactccctagctagggaattcagggatctagaatgctgaaggggatactgagtcagatcaataaaaacaagattgtctagaatctaggcaatctatatctttggcaacaaaagcagctgtagactcttctactggtggagagaagtctcctttagccccctggcctggagagctgacagcagggtccagactccctctggaaccttctgaccatctccatctggactgacgccctccatgcctaaagcatacctgcctacctggccttggcttctcctctctcctgtattaaatcccatattgggcgggcacagtggctctcgcctataatcccagcactttgggagactgaggtgggcagatcgcttgagctcaggagtttgagaccagccctgggcaacatggtgaaaccccatctctaccaaaaatac

SEQ ID NO: 276013 - DNA, 915 bp, Homo sapiens
ctgaaataatttcaagatgttcattctctacagttttgtggtatgattaacttcgaagtccactgcagacacaaatgaactttccctaaaatgcaacacgagagtactaactacagtcggtaaagatgagagggggttattttgtagctcttcctgcaggctgtgagaatttttttcgttaaaaaattcgttaaaaaagcaggatatactgcttcagtccttaccatgagagccactcccatcggaacataaattagtcttagtatatttcaggttctcccacatgttcacattccaactgggtgcaacagttgacttttgtctttaactttccttggcaaaccgatagcatcagaggaagagataagctgccccttagggagctgattgtaatgcgttccagacgtctgcacgcccctggtgcaagcaccagctttctgttaaagactcagggttatgttgtttggatgttttgttgtttgctttttgaaaaagccagatcagatttttgtcattgtataaactccagtaggagaagagggatgcgtttttaaggtgatttctagaatgctctggccgacttagctgcagaagaaaaaggagaaaggaagagacagtgtatattttggcactgaaacttctttagtaacaatgcattcattcacaaatctggagagaactgaatgtctgctttttaaagtctgaattgaattctcgactagactttgagaccctgagaaggttttcaatccaaaccatgcttaatattcacgttttatcattattgatggaaagtgaaagaaaatttgaattcttggtagccagatttgacattagacttttacatttataacctcacttaaactttacaagaaatctcattacaggtattattatccccatttttaaagcaaa

SEQ ID NO: 276014 - DNA, 468 bp, Homo sapiens
ctcagcctcctacagtgttgggattacagacgtgagccactgcacccagccactcctgcacccttaccttttcgccgccctggccggctggacgactgcacccatttcacccggcattcttgtgcctgactgtgctctggccatttcctgtgtctggaatacccccattctcccatgctcagccccgtggactgtgtttattcgtaatcacacctcagagcccttccccttctccatggactccacccctgctgtgtagatggccccaacatcattttgctgagtggagtgccactgcaaggcatggcatggaggagcctgactgcataggtggcggcaccttgagggccttacagacctggcagttgaaggtatgggctagaagacagatgattccaaattacggctaagaaataggtaggctgtaaggcttgattgccgtgaatgcctctagaaagagcacttaaa

SEQ ID NO: 276015 - DNA, 341 bp, Homo sapiens
atgggcatgtctttttatgctatgacagtcatctctgggatctactagataatcaaagcagcctggacaataatacatgcaaagcatccagcaaatgttcatgaagtttctgcaaagaacagatttctatcgtggagagaagatgcctctgtggaactgcatcctcaattatgtataagccatcagcttacattttgaaggagtgttattttctttgcatatcaaagactttcaaaaaaatgaaaaagtcaaatttctcaaaatgtatagaaaatacaatgggtatggggttctcaaagttgatcgtgttattagaaaataaataatatagcactccttaa

SEQ ID NO: 276016 - DNA, 393 bp, Homo sapiens
aataagatattttttattgaaatgcaaatgtacgatgaagtgactcagtttagatgaagtgtctcagtttagaaactgtgactgaggtatgcacagtcaaggtgggcaggacagtaactgagacaggttgatgctggcttcacactcaagatttcatttactcctcccggtcttgctaactcctgagttgtacaagtttcaggagactcattttatacacgcagagccccagaccctgagagatcgtgtctgagtctgggccagaaagggtcccccgtttccttatgtcgggccattgaacagagactgtgggagaaatgtgtggactcacagcagtccccagacactggacccaggtagtgttaggaatggaaaaggggagagagtccctga

SEQ ID NO: 276017 - DNA, 250 bp, Homo sapiens
aaacaaattcagcaaacttttggaacagcccaaaataatccaagaaaaaattaagaaaacaatttcatttatagtaccatcaaataacccgtttattaagggaaaatttgaaaaaaataaaactgtcacttttcccatatgatatggttctatacatagtggatcctgaagaacctatactaattgaatgaataactgaacattgtaaagtcactagatacaaggtatatatacagatataaattgtatt

SEQ ID NO: 276018 - DNA, 761 bp, Homo sapiens
ataattttcaagaatgcctaatcagttgctctccattctgcatcctcccagtttcaactttcttcctcaatctctctacccggcacttcctgcacacctctcagccactacccacctttacttgggaggaagagaaaaaaaagaaatgagctccagactcaagctgctagatatgattcagtctaaagtttgttggaagtatggagcccctcggtattggcgaggaacaggtggtacaaggcaaagtaggagaggagggatgcataaataatgctggtggtaagagtagtcttcacctctattattcatcaactgaatgacacctctgagtcattcatcaactaggagagaggtggtgggtggtacccagttccactaactgctgccaccatgagaatcagaaattttacgagttccccaaatatcagagagacaccttgatttgtcatctgtctatccagtggaattccaaatgactgacaattttagaaaacacttggaaaaaaaatatatgaaaagcttattttaatcgccatagcctcagaatctatactccttactcattaaatgtatgattttagacaatttacttcaccaatcccagtctcagtttcctatctgtaaaaggaaataatatagcatctcttaggaatgttgactgatagctcctaagaagaatgttaaaaggttgagattaatcaataaatgtaaagtattgggaacagtgcctggcactttatgtaaataaatattagcttcta

SEQ ID NO: 276019 - DNA, 248 bp, Homo sapiens
cttttgtgagaatttgatgaatccggacatgtgaagtgctcagaaaggtgtctggcaccaagtgaaggctgtttgctatttgctgttgttattgttactcaggcacaaaggcagagaggagcaaatggtccctgggagcaaatgagcaggtggaggctaagatcacttggacaatggaactccatcgtctgccggataatctgccatcatcttataaatccactatgtctaaaagaaacaccatcttt

SEQ ID NO: 276020 - DNA, 545 bp, Homo sapiens
gcttgtggggtgcagtccccccatcactatctggggccatttgtgccaaaaccaatgcactgccacagcccctgagtccagcacatcctcgcaccctgcgtccctggactgtggtccaccctagccagcagcacccagagctctcctaaccaggcaggagctccatgtgacagatgaggaaactgaggccagggcaggtggcgccgacctcactccagaataggcacggacagtgggacccagaatgcccacgggcaccatgttgggagctggatgggcactgagggtgaggctggacccctttctgaaggagggacgtggtgtctgctcctgtaccccatggtgggtgctcaccatctccccagcccacagtttacttggacagccccacagtgacccactttctccccgaaatgggctggatctgcctctaggtgttttctgtctcggcccaggctttcctaacaccggctggtgccatccaagcctcctgcagggtcagcagatttgcaaaccacaggtttctccaatttctttggagaaaa

SEQ ID NO: 276021 - DNA, 233 bp, Homo sapiens
aaaataaatcagccaggctaagaaagaatatacaaattaatacagaaatgaaagcacggacattattatagatcccatgaacattaaaaggataataaaggagtataatgagcaactctgtgcctaaaaacttagtaacttaggtgaaatggaccagttcattgaaagacacaatagcccaaaatcatacaggaagaactaggaaatcttaataaggcaacatctgttaaaca

SEQ ID NO: 276022 - DNA, 210 bp, Homo sapiens
ctctgttgtctctttgtatgtccaggtttcctcttcttataaagacctcagtcagattggatgggggctcaccctgaaggcttcattttaacgtaatcacatctttagaggccccatctgcaaacaggagcacatgcagagatagtgggattagagcttcaacatgagttcggggaacacaattcagcccatagtatcccataataaagg

SEQ ID NO: 276023 - DNA, 248 bp, Homo sapiens
  misc_feature (202)..(202): n is a, c, g, or t
  misc_feature (207)..(207): n is a, c, g, or t
cccaagtggtgaattatctacaagtttgtagcaaagctaatactcagactccctctacagccttgctactcagtgtagtctgtggtccggcagtgtcacaccactggggtacttagcagaaatgcagcttctcaggctccactccagctctcctcaatcacagtctgtttttttgtttgtttgtttgtttgttttgagatcncgccnctgcactccagcctgggcaacaagagttgtctcaaaaaaca

SEQ ID NO: 276024 - DNA, 418 bp, Homo sapiens
cccaagtggtgaattatctacaagtttgtagcaaagctaatactcagactccctctacagccttgctactcagtgtagtctgtggtccggcagtgtcacaccactggggtacttagcagaaatgcagcttctcaggctccactccagctctcctcaatcacagtctgtttttttgtttgtttgtttgtttgttttgagatggagtttcgctcttgttgcctaggctggagagcagtggtgcgatcttggctcactgcaacctccacctccctggttcaagtgattctgctgcctcagcctcccagctgctcaggaggctgaggcaggagaattgcttgaacccgggaggcagagattgcactgggctgaggtcatgccactgcactccagcctggcaaccgggcaagactccatctca

SEQ ID NO: 276025 - DNA, 1091 bp, Homo sapiens
cttaaaagcacagtcagtagaagcaaaaataaatgtggcccaggagtggtggctcatgcctgtaatcccagcactttgggaggctgaggcgggcagattgcctgaggtcagaggttcgagaccagtctggccaacatggtgaaaccccatctctactacaaaaaaattagccaggcgtggtggcatgcgcctgtaatccccagccacttgggaggctgaggcaggggaattgcttgaaccagggagggggaggttgcagtgagctgagattgctccactgcactccagcctgggcaacagaacgagactccatctcaaaaaacaaacaaacaaacaaaaatttgatgtcaaagtcccattgttaaaagtcttttacacaacaaagaaaacaatagaatgaaaagaacacctacagaatgggagaaaatgtttgcaaactacttatctgatctattatatacaaggaactcaaacatctcaacaggaaaaaaaaaaatcccaatacaaaatgggcaagtgatctgaacaggtatttctcaaaagaagacagatggcctgcaaatatatgaaaacatgttcaatgtcactaatcatcagggaaatgaaaattaaaaccacagtgaggtatcatctctaggatgactattatcagaaaggcaaaaaaataaatgctggagagaatggggagaaaagggaggtcttatacactattggtgggaatgttttccatagtacagccactgtggaaagcagtatggaggtttctttaaaaactgaaaatacaacaacatgatccagcagtcccactactggaaactattccaaaggaaaggaaatcattacattgaagagacatctgcacactaatgtttcttgcaccactattcatgataaccaaaatatggtaccaacctatgtgtccagcagcagatgaatggataatatgtggcatgtgtatatacacaatggaatactattcagccataagaaagaatgaaatcctgtcatttgcagcaacatggatggaactgaagaacattatactaagtgaagaaacaaagttaaatactgcatattctcactcatgtgga

SEQ ID NO: 276026 - DNA, 815 bp, Homo sapiens
atctcatgaggcagcacacaattaatttccaaatgtgtatcaaaaatttcaagttaggagactgagttagaaatgattgatttttttaaaaaggaaaaacagagcttttttcttttcttttcataactttggtaaatctaaaattacattgtttggggccatgaatgtttattatgtaacacttggttttgggggcatgaaaatctattgtataacacttggcatgcttatttaaacaatttggttgatatatttaggatataatatatgttcatcttgtctaaaaaaatatggagaaaggaagtccctccaccttgccatctcctatctaggtgactttgagtatggtgatgacattatagataccacaccgaaaccatgattcattaaaactaattcataagccagacttcattagaattaaaggtttctgctctgtcgaggccactaacaaagaataagaagatgaccccatagactgggagaaaatatttgcaaaacacatatctgataaaaaaaaaagactgttatccaaaatatacccaccccctgaaaaaaccctcttaaaactcaacagtaagaaagtgaacaaccagattggttgcccacaacaaatgggcaaaagatctgaacagacatctcaccaaaaaagatacagatgactaataagcacataaaaagatgttcaccatcgtatattatcagggaaatgtgactcaaaatgatgagatacctctatacacctatttaaatggcaaaaattcaaaacagtgagaacaccaaatgctggtgagaatgtggagcaaccgggactc

SEQ ID NO: 276027 - DNA, 435 bp, Homo sapiens
cctcagcctcccgagtagctggtaagggaggagaccacccctcacattgtcttatgcccaatttctgcctccaaagaaagaagtaaaaactaaaaggcagaaatgaaatccacaggcagacagcccggcgctgcaccctgggcctggtagttaaagatcgacccctgacctaatcagttatgttgtctatagattacagacattgtatagaaatgcactgtgaaaatccctatctgttttgttccgatctagttaccagtgcatgcagaccccagtcacgtaccccttgcttgctcaatcaatcccgaccccctcacacgcaccctccttagagttgtgagcccttaaaagggataggaattgctcactcggggagctcggctctcgagacaggagtcttgccgatgcccccagccgattaaaccccttccttca

SEQ ID NO: 276028 - DNA, 369 bp, Homo sapiens
atcaatggagcaagcagggggactgaagcctgagttcagtgcaaactgtgtcctaccacactcaactctggagaatcagactctgctgagatgcctcttcttgtggcaccatccttataattgggtctaaatcttcacttaagtatcatttattaaagttgagtccttacgaattgattcctgtgtgatcctcaacgttcctctgacctgttgcaaatgctggctctgactaagggctcctacagctttctgcttctctaaccagagaatttactgtttataacttctcagtgagaaagcccactctgacacaggggtgaaggtatattgatttttgtatacatgtattttaataaaagtaattcatgc

SEQ ID NO: 276029 - DNA, 3651 bp, Homo sapiens
gggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaagggcaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcatagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatcaatacagagtggggaggatttggagacaatggctgcatagatgacatccggacccgatacgacacggaggtggatgaggggtccttgaatcctggcaagcagagatacgagaaaatgaccagtgggatgtacttgggggagattgtgcggcagatcctgatcgacctgaccaagcagggtctcctcttccgagggcagatttcagagcgtctccggaccaggggcatcttcgaaaccaagttcctgtcccagatcgaaagcgatcggctggcccttctccaggtcaggaggattctgcagcagctgggcctggacagcacgtgtgaggacagcatcgtggtgaaggaggtgtgcggagccgtgtcccggcgggcggcccagctctgcggtgctggcctggccgctatagtggaaaaaaggagagaagaccaggggctagagcacctgaggatcactgtgggtgtggacggcaccctgtacaagctgcaccctcacttttctagaatattgcaggaaactgtgaaggaactagcccctcgatgtgatgtgacattcatgctgtcagaagatggcagtggaaaaggggcagcactgatcactgctgtggccaagaggttacagcaggcacagaaggagaactaggaacccctgggattggacctgatgcatcttggatactgaacagcttttcctctggcagatcagttggtcagagaccaatgggcaccctcctggctgacctcaccttctggatggccgaaagagaaccccaggttctcgggtactcttagtatcttgtactggatttgcagtgacattacatgacatctctatttggtatatttgggccaaaatgggccaacttatgaaatcaaagtgtctgtcctgagagatcccctttcaacacattgttcaggtgaggcttgagctgtcaattctctatggctttcagtcttgtggctgcgggacttggaaatatatagaatctgcccatgtggctggcaggctgtttccccattgggatgcttaagccatctcttataggggattggaccctgtacttgtggatgaacattggagagcaagaggaactcacgttatgaactagggggatctcatctaacttgtccttaacttgccatgttgacttcaaacctgttaagagaacaaagactttgaagtatccagccccagggtgcagagaggttgattgccagggagcactgcaggaatcattgcatgcttaaagcgagttatgtcagcaccctgtaggattttgttccttattaagtgtgtgccatgtggtggggtgctgtctggggcatctgtttttcattttgcctgtggtttgtgttgcagctgttgatagttgttttaaggattgttaggtataggaaatccagtaaattaataaaaaaattttgattttccaataaactttgcatgaa

SEQ ID NO: 276030 - DNA, 2325 bp, Homo sapiens
gggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaagggcaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcatagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatctgtttttcattttgcctgtggtttgtgttgcagctgttgatagttgttttaaggattgttaggtataggaaatccagtaaattaataaaaaaattttgattttccaataaactttgcatgaa

SEQ ID NO: 276031 - DNA, 2669 bp, Homo sapiens
gggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaagggcaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcatagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatcaatacagagtggggaggatttggagacaatggctgcatagatgacatccggacccgatacgacacggaggtggatgaggggtccttgaatcctggcaagcagagatacgagaaaatgaccagtgggatgtacttgggggagattgtgcggcagatcctgatcgacctgaccaagcagggtctcctcttccgagggcagatttcagagcgtctccggaccaggggcatcttcgaaaccaagttcctgtcccagatcgaaaggtgacctgtgatcaagttcatcatgaggctctgactggcatatgctgccaccacgctggggttgggccaatttgaggtttaaaaataaaaacagaaaggccctggctgggtaagggattgcctcctggggctgctcttctctttccaactgattcaggatcgctttcaacaataataaactcatggccaaactgggctcatctaaa

SEQ ID NO: 276032 - DNA, 277 bp, Homo sapiens
agatgcttgcctcctaacagtcttgtaggggcgctactcttctccctgttttgtagatgatagcttgcagtgcttgctcacatcaagcagctagtatgtggcagagctaggatctggatcttgctccatgcgtagctccaaagcctggccttctcacatcatgtggtcttctgcattgcaggtctgccccaaccttatccttcttctccaaacagatacgagaaaatgaccagtgggatgtacttgggggagattgtgcggcagatcctgatcgacc

SEQ ID NO: 276033 - DNA, 316 bp, Homo sapiens
ctacatggaagggctgatgatgtttctttctctttttcatagcttttctagaatattgcaggaaactgtgaaggaactagcccctcgatgtgatgtgacattcatgctgtcagaagatggcagtggaaaaggggcagcactgatcactgctgtggccaagaggttacagcaggcacagaaggagaactaggaacccctgggattggacctgatgcatcttggatactgaacagcttttcctctggcagatcagttggtcagagaccaatgggcaccctcctggctgacctcaccttctggatggccgaaagagaac

SEQ ID NO: 276034 - DNA, 1423 bp, Homo sapiens
  misc_feature (5)..(5): n is a, c, g, or t
aaggnccagccgattcgctttcgatcttgggacaggaacttggtttcggaagatgcccctggtccggagacggctctgaaatctgccctcggaagaggagaccctacttgggggagattgtgcggcagatcctgatcgacctgaccaagcagggtctcctcttccgagggcagatttcagagcgtctccggaccaggggcatcttcgaaaccaagttcctgtcccagatcgaaagcgatcggctggcccttctccaggtcaggaggattctgcagcagctgggcctggacagcacgtgtgaggacagcatcgtggtgaaggaggtgtgcggagccgtgtcccggcgggcggcccagctctgcggtgctggcctggccgctatagtggaaaaaaggagagaagaccaggggctagagcacctgaggatcactgtgggtgtggacggcaccctgtacaagctgcaccctcacttttctagaatattgcaggaaactgtgaaggaactagcccctcgatgtgatgtgacattcatgctgtcagaagatggcagtggaaaaggggcagcactgatcactgctgtggccaagaggttacagcaggcacagaaggagaactaggaacccctgggattggacctgatgcatcttggatactgaacagcttttcctctggcagatcagttggtcagagaccaatgggcaccctcctggctgacctcaccttctggatggccgaaagagaaccccaggttctcgggtactcttagtatcttgtactggatttgcagtgacattacatgacatctctatttggtatatttgggccaaaatgggccaacttatgaaatcaaagtgtctgtcctgagagatcccctttcaacacattgttcaggtgaggcttgagctgtcaattctctatggctttcagtcttgtggctgcgggacttggaaatatatagaatctgcccatgtggctggcaggctgtttccccattgggatgcttaagccatctcttataggggattggaccctgtacttgtggatgaacattggagagcaagaggaactcacgttatgaactagggggatctcatctaacttgtccttaacttgccatgttgacttcaaacctgttaagagaacaaagactttgaagtatccagccccagggtgcagagaggttgattgccagggagcactgcaggaatcattgcatgcttaaagcgagttatgtcagcaccctgtaggattttgttccttattaagtgtgtgccatgtggtggggtgctgtctggggcatctgtttttcattttgcctgtggtttgtgttgcagctgttgatagttgttttaaggattgttaggtataggaaatccagtaaattaataaaaaaattttgattttccaataaactttgcatgaa

SEQ ID NO: 276035 - DNA, 1896 bp, Homo sapiens
gggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaagggcaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcatagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacaggtgggccagcacagcctccctctctgaacagccatccagggctcccgtcaaaactccttaaagccagtgaggttcttggtttttagaaacttgggttcacgtctctaatggagggcaagagtaagaagaaggctagtattctttctaaatctgttggcctttgttaacccaaggcatttgcagtaaaaacaaaacaaataaacaaacaaaaacacaaaaagcctacattaggtta

SEQ ID NO: 276036 - DNA, 341 bp, Homo sapiens
gtattataataataataataaacttaagaagagttttcatgattaattagatcaggcatggttccaggttttgtgaagttttaagattatgtaatttttgaggctgtctgtaagaagagagaacaaaattttgaatgcaaagttagttcctggtccttggaaggggcctgtgtgggccccggaacttaagtttccatcatgccatgctggattcacctgttgaaatgtatgcgacacacatacattttgtttacttatgccttgctccgcctcttttggggggcgttattgctcactattattccattatgaaaacatacctacttgtcactgatacaatt

SEQ ID NO: 276037 - DNA, 498 bp, Homo sapiens
aggcagaagtacctcccgtaggcctcgctcttagctcctaaattggctcacgctggccacagctcacacttgaggccccacaccaggcactcatctgccagccacccctgcctgcaggaactaccatcggccaggacctaagttggatggatctaatcaccccatctccagacacgctgtactcgcagcctcagctctctgccctctgctattctgcccggtatgaccagaaccaccctggacacaaccctccgccactggcacattctgctcccagacactccagcctcctccagaaccccctccatggatattccagatgtggcggtcctgcagccttggactccctcggcccaacacactgatgagtgagtaagagtgtagctgagcttccaggtcctgcagcctccggggaatgtccagggtgtggatagacactgggcctgaagctccaggctgtggtcagcgctgggatggaaggaggcaggtgcacaggga

SEQ ID NO: 276038 - DNA, 722 bp, Homo sapiens
agcgccctcgcgaccggaagtgcgcgctcgggggtaggcgggaaggccgcggcgggattaattaaagacccgatcaagcggcccgcagaggggcgtgaccttgtttcctcaggagtgtggcggtggtcttactactatgttcgttatagcgcggcagaaagaagaaatgttatgacaacagagcagcaagtcccatggtcctagctaaaaggcggtacggctgtgactgctgagatggagagtcctcaaagagggagtctcgctctgtcgccaggctggagtgaagtggcacaatctcagatcactgcaacctctgcctcccaagttcaagcaattctcctgcctcagcctcccgagtagctgtgactacagagaattaaacttatggtctctcacctgagcatggagtggaaatgggcatataaggtaatcacagaagttatcacacctacacccttcccagtatatggatgtactagggaggaagattccatggaagaggtaaaatctccccgcatgcttcattatagaaagaaaaagagaacactctcttcctaacagaacggaccactgtctcagcatgtgggatggtgataatgagggaatgattacctaccatcagatcaacaattagtatacactgaaattacaatgactgtgagactgacctaagtgtgaatatacaacttctgagcttccactgcctttggagggatcaccac

SEQ ID NO: 276039 - DNA, 386 bp, Homo sapiens
agcgccctcgcgaccggaagtgcgcgctcgggggtaggcgggaaggccgcggcgggattaattaaagacccgatcaagcggcccgcagaggggcgtgaccttgtttcctcaggagtgtggcggtggtcttactactatgttcgttatagcgcggtacgttctagacccttctataggaaatttaaaacctttaaaatgtgtatttccttcctccagtcagtgaccacgggggcgtctccatgagattaagacaaagattataatagagttccagactatcctgggcaacatagcaagacctcgtctctacaaaaaatcaaaaataggccaggcttgttggcctgcccctgtggtcccagctactcgggaggctgaggaggaagatt

SEQ ID NO: 276040 - DNA, 413 bp, Homo sapiens
catatgttagactgtaaatcaagtctcagtcaaatttaaaagatatataaggtatcttctctgaccacaacaggatgaaattagaaatcagtaacagaaagaatactggaaaattcacagatgtatggaaattaagcaacacattcttaaccaatgggtgaaaaaagaaatcacaaagcaaatcagaaaatacttacagacaagtaaaaaccaaatcagaacatacctaaagttagaaggtgcagcaaaagcaacactcagaggaaaattaatagctataaatgcttacattaagaatgaaggccaggtgtggtggcttaatcccaacactttgggaggccaaggcgggcagatcacttgagcccaggagtttgaggccagcctaggcaacatggcgaaaccctgtctctatc

SEQ ID NO: 276041 - DNA, 211 bp, Homo sapiens
atattcttctggacagtttattaaaaacggtgaggctccgaggccacatctctatgtctacaatgtggctgaggggtttatacggcaacagcctgagcttggtgcaaacctttctgtttagttacacagaaagaccaactgcagtcaaaagagttcactagtgactaaccaaggaggctgaagctgtttggctgagctgttgaaggaaggt

SEQ ID NO: 276042 - DNA, 212 bp, Homo sapiens
tcttcccatgacacgtgggaattatggaagttacaattcaatatgagatttgggtggggacacagccaaaccctatcatctatcaattggagcaagccaccaagcagatgattgtgaacttttgtgccctcacaaagaaattgaagtgaagtgtaagaatgcttttggctataaatagaagaaaatccagattcagtggacttaagcaagga

SEQ ID NO: 276043 - DNA, 325 bp, Homo sapiens
tagatctgtttctgagttctctgtcctgttccgctgctctgttgctgtgactgtcccaccccatctgggttacttgctgcagcgctgggagagggattcctctggcttcctctctcttttctctttttcaagattgagctcttgaaaaaagagctctgggagctggcattttggagctcctctagggttccgcgtgtagaagatggcactgtgttgggcctaggttcagagtcgtccttgacaccacctcatcctcagcccgtgtctgactcatcagcgagcattgccttttcttggtagacatagcccaggtctgtccccctct

SEQ ID NO: 276044 - DNA, 300 bp, Homo sapiens
atttaatttttattgatgattttttcacaaccagcttacaaaaacttctgaacatttagcagtcaactctcttcagctgatgtgagtcagctagttccagcacactcactgaccaggtgactgtggatttgtcacttaatctttttggttttaagcagctttattaagagataattcacataccatatgatgtatcatttaagtatacaaattagtggtttctagtatacagcctgcccttcatgtctgggttccatatccatggagtcagccaacactggattgaaaatatttggaaaa

SEQ ID NO: 276045 - DNA, 997 bp, Homo sapiens
atgctcattggtttgaagaaatcacactgattcttgattggctatgcattgttaagctatggggtgtgggacatagtgtcccgggagcattattaggttaatgcatctctatctgtggcaatggcaagcagtttcaatagatgaatacatagctgacagtggggagtaggatgtgactgctgtctcagtttaatgtctctcggcctaataatttgaaagggctcacaatcctccgatagaagctcttttctttcctcctcgagtatctcagtgtccatctttagagatcatccttaacaataaaactggctttttaacctactccctaatcaccagtcatccaactttgagttaataatgctaatttcagcctcactcctgactctcgcaccccaccactcccagccaggaaatgcttctctgtgtccacgatgccttccagcatcttccttacatggttatattgcactccctgtaattactcagcactcagcaacttggttgtggcatactctgaaaagccttcgacaagctacacaagggcttgtggagcttatggattcacctctaagaaagcaaaaaaacacactttcatctccacatgtttactcaggtctgttcttcctttcacaagcagtggtgtttcctactaggatgtttccaagttcaccctgttaacaacagaattagtttagtactggagagattaatcattaaccttggtgtctccactttctggctcacaaattttaactatgaagttagaaataaaattagataaggaagggctcacaaattttaactatgaagttagaaataaaattagataaggaagatatctaacatgtctactttattgtaaatggtagcaattacatttgtcacttaactcaatttgcgaatatattttatctaatgtaaacatatagatcaaagttatatatattatcaattggctaatgtatcacctcattctaaataaaaaatttaaggactt

SEQ ID NO: 276046 - DNA, 355 bp, Homo sapiens
ggttatggcaaaatcaataagaagcgaattgctttgatacataacactttgattgcttgatctcttggtaaatatggcatcatctgcctggaggatctgattcatgagatctatactgttggaaaatgcttcaaagaagcaaataactacctgtggcccttcaaattatcttctccacgaggcggaatgaagaaaaagaccacccattttgtagaaggtggagatgctagcaacagggaggaccagatcaacaggcttattagaagaatgaactaaggtgtctaccatgattatttttctaaggtggtcagttaataaacagtacctactctcaaattgaaaaaaaagtcgacgc

SEQ ID NO: 276047 - DNA, 286 bp, Homo sapiens
aaagaaagagacagagagggagagagaaagaaggaaagaaaggaaagaaatgaagaaaagaaagaaaagggtacctaaggactggggattctgaatcaggaacttctgtctgatcttccaagagttaagagatttgaacacgtgaacttaaagtgaaatacaagcccaagaaaacattaggtcttattgatatcatgagcccatttttacctttcccattctgcctcctctcccactttgcaccatatgagtgatagcatgttacccctttcatgacatgacatcc

SEQ ID NO: 276048 - DNA, 391 bp, Homo sapiens
tcgtagcttagctgctgtattcccaaaacccacacagtgccccagagctttacccttggaattattatcagagataagttccttaaagccacagcctcatctccaatcaagggagttccttggagggacttggaataggaagaagctagaaccctctgagatctggccatccaccacccatgaggcccaattcttccctggtcccctgagcaactgaaaatcagctcctagagtatcatttcagaactttgagcatttgggcttcttttattttattttattttgttttatttatttattttttgagacaggatctcactctgtcgctcaggctggagtgcagtggcgtgatctcagctcattgcaacctccacctcccaggtttcagtga

SEQ ID NO: 276049 - DNA, 426 bp, Homo sapiens
tgatttttgtgagaaaagagggattataaaagactgctcctagccaaccttttgcccatgagggaaatctacaagctcagtccttgtgaagctggggttttgggttcccagaggcctcaaccactccttttcctgtgatcttgtggctgggatgacagtgcatcagcagaggatggatcgtttcctgcaggctcagcccacactccgtgtagcaatcttgggggatttctgtctggaaaacagtctggcggttcaatccacagacagtcccccaaccttcctctatatcttatagaggaggtgggaaaacgaggaacacttgaatgagaggccgtgcatatatgagttgcctacaaaatctgtcatttttggaggtattatttgaagggaacgtttatttatttatttatttatttttttttttta

SEQ ID NO: 276050 - DNA, 588 bp, Homo sapiens
ccttgacctcccaaagcactgggattacaggtgcgagccaccacacccagctggatttttctgttttagatattcctgtacatgtccccatctctataaaagaaaaaaaagcctagttggtaaccttttactacactgccctgtgccacctttcatatgatgatactaacctctttaatcaccattaaagagctccgtactctttcatagttaactttgttactgtaaaagaacatgaaaggggtatcccaagaagagaaacaatagcagctattagtcccttgggctgtgtttctctgaaggatttctcaggaatgaaaggagccctaagttatttagagtcctgcctttgtttcactgttgctctctctttctctttagagctctttctttctctccttttgaagttagtactaggctttgtgagtttgaatgaaagtgagccttggtgcttggtcggtacctcctctttcctcatttacccctcatttactcctgcatacattggtggttctcataagggatttccagcacattgccatcctcccattgcagctggagcatagcactggggaaaggaggcaacac

SEQ ID NO: 276051 - DNA, 553 bp, Homo sapiens
tagagatggggtctcactctgttccccaggctagtctcaaactcctgagttcaagccatcctcctgccttggattcccaaagtgctgggattacaggcatgagccaccacgcctggccccacattaaaaattttgaaacggtagctttgattcaggtgtaactgtcctcctaaagaaaaataaaatgttctgagaagttttagtttaaagttggaaagcactgagaataaatctgttttgggggaaacattgaaatgctacgtttgaaaatctgtagaatttgcttcaggtgagacaaaggatggggtaagtcattgaaaggactcactgggacacatgtgcagtggagggtttaaaagtatttgcggaaaaatatttagaacgtttaatttctaaattagaaatgtatgagtgaatttagggggaaggggctggttaagtacccagggattggttccacagttgctgagcatacactgtcaccaagtcagatgtggctactgtcctcggggaggtgacaggtagaggagaaagccttatccactaggtttta

SEQ ID NO: 276052 - DNA, 1608 bp, Homo sapiens
aggcagacaagaggcaggtttttattttagactgtgatgttgaaaattttgtgatcactttttacactgtcccaggacatacagaaccaagacatagtgtcccaagtagtatctaatttcatatactttaggtagttctattccatttccaaaggtttagaataccgccccacctcaacccccaggaaactggggagcactccctccactacacacacttgggacacgaaggacagaccctggttggggaggcacttaggtgtcccttccttaggggctttatctctcacttcccctcctgggttggaggctcctgtgaccccctcgcctgggcaggtccccatgcagggtagagcacttggaggcctctgtaaacatgggttacaggagagagggggcaagaggccacagctggggtacataaggaaacccctctgtgggcccccttactcagagaagtctcaggagaaaccctttcccccacccccagtcctggcaccaagctggagaaagacaaaatggcttgtgaaggcatctgtctgccctccagggtggctgccaggggggcagccatgatggctggcctggtgtgggtgcctttgtgtgccatgactgggtgtctgtttctgcagtcactaggcgcttgttctgtggggtgaggggtgtgggggtgggggcacggcctatggcagggcacgtacgtgaggctgggcacgaaaagcctcttgtcccctttcccagatccaccaagcgtctatgggcagactgttttttcctgcacttcctagtggccagcagagggcgccgccaaaagactgaggccaccacggagggaacaggagaatcggctttttggggtctagccactgtgcagagcccaggcgcgtgggtcggtgtcgggtgtgtgtgtacgtctgtgtgtgtaatgaaactggacgccttccttcccggcgatcttgacttaacctgtcagcagagggcttgaggttagaccacaggttgaacctaggtggctgctggagaggtaagcccaggtggctcttggcaggaagaggaggatgagtgagttgctcccttctagcaacccaaatgggaagggacaacggaggttgccagctttcctccctgaccctggaagaagggttgggaggggttgcacagaatagctggtgtcccaccctgtgggaggaactgctatggacatctgggccacatctggtttcctggcaaggcagggagctggtctgtttggaattcttggtccaccgcttggtggtccctcaccattacattctaggaggaccctttacaaacaggtgtatagggcgcagccctgtaatgcgagtgagtccacagcaacctagtcgtggtcacactcctttggaagtggccctaggggcctgggcagcagcctgctcctctgcgccactcgacctttctgtggccatgttggagtctgcatgctgagatgctgccctttccccttggaaatgctgggaaatgtgctctggtgtccatcctggccatgcctcttcctccaggtggggtaagagatgaaaagaggagttagtctgcagtacctcttagggaccccaccccatgaaaggc

SEQ ID NO: 276053 - DNA, 3073 bp, Homo sapiens
aggcagacaagaggcaggtttttattttagactgtgatgttgaaaattttgtgatcactttttacactgtcccaggacatacagaaccaagacatagtgtcccaagtagtatctaatttcatatactttaggtagttctattccatttccaaaggtttagaataccgccccacctcaacccccaggaaactggggagcactccctccactacacacacttgggacacgaaggacagaccctggttggggaggcacttaggtgtcccttccttaggggctttatctctcacttcccctcctgggttggaggctcctgtgaccccctcgcctgggcaggtccccatgcagggtagagcacttggaggcctctgtaaacatgggttacaggagagagggggcaagaggccacagctggggtacataaggaaacccctctgtgggcccccttactcagagaagtctcaggagaaaccctttcccccacccccagtcctggcaccaagctggagaaagacaaaatggcttgtgaaggcatctgtctgccctccagggtggctgccaggggggcagccatgatggctggcctggtgtgggtgcctttgtgtgccatgactgggtgtctgtttctgcagtcactaggcgcttgttctgtggggtgaggggtgtgggggtgggggcacggcctatggcagggcacgtacgtgaggctgggcacgaaaagcctcttgtcccctttcccagatccaccaagcgtctatgggcagactgttttttcctgcacttcctagtggccagcagagggcgccgccaaaagactgaggccaccacggagggaacaggagaatcggctttttggggtctagccactgtgcagagcccaggcgcgtgggtcggtgtcgggtgtgtgtgtacgtctgtgtgtgtaatgaaactggacgccttccttcccggcgatcttgacttaacctgtcagcagagggcttgaggttagaccacaggttgaacctaggtggctgctggagagaaacactctgtcttcctgctttgaggacagctgaagtcttgccacttcttctggatgctctgaccctcaccctccgcagaatgcaggcccactccgttgctgaagggcctcctccttgggccagggcgcctgcttctgccagtggcatcatcaccccactcctcagccgccagtcatcagagacacggtctgactttgttaccccggctggagtgcagtggtgcaatcatggctcactgcagccttaacctcctgggctcaagtgatcctctcgccaaggctaggataagtagctaggactacagatgcgccccatcacgcccagctaattttacaacttctgtagagatggagtgttgctgggttgcccaggctggtcttgaattcctgggctcaagcgatcctcctgtgtccggaattggtgggttcttggtctcactgacttcaagaatgaagccgcggaccctcgcgagtctgtatccaccagctactcttccagattcatgaggcaaggcctgcctgctcacctggctggccccaagcacctcttcaacctgttgccaccgtcctgccttgctgcccttctcagctcatccagcagggtctccaagtcgtggaaacagaagcacatatacacacatgctcatatgtacatgcccacagtcacataagcacaccgagaaacaccatcgcagacatgttctcacaagcacatgtgcataacactcactacccctcacgcgtatacacattaatacacacactcatgcacactcagtcttacacacacagacacacagccataatcactgttgttggttgaattgtgcccccccatccccaccaaaaagataagttggagtcctaacccccagtacctggggatgtgaccgtagttggaaatagggtgtttgtagatgtaatcaaattaagatgagatcttactggattagagtgggccttaaatccagtgactggtgtccttataaggagaaaaagatttgaaaacagagacatggagacacagagcagaaggccatgtgatgatggagtcagagattggagtgatgcagctatgagccgagaaataccaaggtgctggcagcccccagaagcaaggagagaggcaaggaacaatctccatcagagcctctggaagaaacagactctgccaacaccttgatttcagacttttggcctccttcactgtgcgagaatacgtttctgttgttttaaactactgagtcaccaagtctgtggtactgtgttatggcagccccggcaacaaatccaatcacacacacacacacacacacacacacacacacacacacacacacagctggctccaggctcagtgatgagctcagaggagttccccttgggagctgctctttctctgtcttccttccttagtgattggtccagtggatccacaaaagctcatggcccagagcaggagcccagtcatttttaattcctcttccctggagttcttaaccatgcgttgccctcaaaatctgctctcaagatttgggttgccatatttaggagcaccagaaaacatacaggaatgctgtgtctgcttgcatcatattaattaaaaactggaaataacctaaatgtcccagaataggtacataaactgtggcatatccacttaatggaatactactcagcaatacaaaaggaaaacctagtgttacttgagcaacatggatgaacttcacagacataatattgcacagcacgaggcagacacaaaagtgtgcatatgctatgattccatttacatgagattcaagaacaggcaaagcagatctatggggatagaagtcagaatagtggttacctctggaaggtggaattgactgggaggggcttcagggaacctcctggggtgctgaaaacattctgtgcttgcaccgggtggtggttatgtgggcattacataaaattcaccaagctgcacccttaatgatttgtacaatttgatgcacaaatctaacatctcaagaagaataaattttacaaagtacctaagaagca

SEQ ID NO: 276054 - DNA, 3308 bp, Homo sapiens
tattcttagtaagtttcattcatcaaagcgtgacaaatggtgtcctgggaggaatgcctgggcgccatggggagccagagggtggggtggggtgcaaatgtcccatttgaggggagaggccattgccttcagggagctccagatggagggggagacagccctgtcctcatgggaatctgtctgatgcagaagacacaaagaacctagtcccaggggagacacagtccctgtcctttgggggaggccccagtctgaaggggggagacagccctgccctcagggagctccagtctgaggggagatgcagcctcatcctcaggcagccccagtctgagggggacacagccccatcttcagggagctccagtctgagggagaagcagccctttcttcagggagccccagtctgagggagacacagccccgtcctcagggagccgcagtctgaggggagacacaacgctgtcctgagggagccccactttgagggagacacggccccatcttcagggattcccagtctgaggcagacacagccccgtcctcagggagccccagtctgaggggagacacagccctgactcagggagccccaggctgaggggagacacagccctgtcctcagggagccccagtcggaggggagaaacagccccatcctcagggaaccgtcagtctgaatcggagacacagccttgccctcagagcgctccctgtgataggagataatcctcccatattccccccttctccagcccttagtgaaatcccagcctgaagggagagatccaatttcctgttctcaagcaacctctagtctcatggcagaaaaatagctaccatccctgatggagaagatagggtgccacccaagtcacggactgaaactcaagatgacaaaagggagtgctggaggggtatccgggagcatgtgcagccaccacggccactgcaagtggggagcctgacgatgacagagaagagggggctcccagagacacttgactgggcacccttaccaagaaacatgcagaccacaaaggggcagcaatcatggggactaagatcctgacgctgaggaaaaggatgtaggcacgggcccagcgggccggtctaaatcagaggtccaccttcactgggagggcagtcggagaacccacattgtctgcagactctcacattcaacctaaaacccatgtactcattgcaagccaaacaaaacctcactgaaggtaaaacgtggcccaaggccatgagtttgcaacaccctggacctcaggaaagaattgatcagtaaggtgggctgcttgtgcctgggggtcttctcaccctccgcagaatgcaggcccactccgttgctgaagggcctcctccttgggccagggcgcctgcttctgccagtggcatcatcaccccactcctcagccgccagtcatcagagacacggtctgactttgttaccccggctggagtgcagtggtgcaatcatggctcactgcagccttaacctcctgggctcaagtgatcctctcgccaaggctaggataagtagctaggactacagatgcgccccatcacgcccagctaattttacaacttctgtagagatggagtgttgctgggttgcccaggctggtcttgaattcctgggctcaagcgatcctcctgtgtccggaattggtgggttcttggtctcactgacttcaagaatgaagccgcggaccctcgcgagtctgtatccaccagctactcttccagattcatgaggcaaggcctgcctgctcacctggctggccccaagcacctcttcaacctgttgccaccgtcctgccttgctgcccttctcagctcatccagcagggtctccaagtcgtggaaacagaagcacatatacacacatgctcatatgtacatgcccacagtcacataagcacaccgagaaacaccatcgcagacatgttctcacaagcacatgtgcataacactcactacccctcacgcgtatacacattaatacacacactcatgcacactcagtcttacacacacagacacacagccataatcactgttgttggttgaattgtgcccccccatccccaccaaaaagataagttggagtcctaacccccagtacctggggatgtgaccgtagttggaaatagggtgtttgtagatgtaatcaaattaagatgagatcttactggattagagtgggccttaaatccagtgactggtgtccttataaggagaaaaagatttgaaaacagagacatggagacacagagcagaaggccatgtgatgatggagtcagagattggagtgatgcagctatgagccgagaaataccaaggtgctggcagcccccagaagcaaggagagaggcaaggaacaatctccatcagagcctctggaagaaacagactctgccaacaccttgatttcagacttttggcctccttcactgtgcgagaatacgtttctgttgttttaaactactgagtcaccaagtctgtggtactgtgttatggcagccccggcaacaaatccaatcacacacacacacacacacacacacacacacacacacacacacacagctggctccaggctcagtgatgagctcagaggagttccccttgggagctgctctttctctgtcttccttccttagtgattggtccagtggatccacaaaagctcatggcccagagcaggagcccagtcatttttaattcctcttccctggagttcttaaccatgcgttgccctcaaaatctgctctcaagatttgggttgccatatttaggagcaccagaaaacatacaggaatgctgtgtctgcttgcatcatattaattaaaaactggaaataacctaaatgtcccagaataggtacataaactgtggcatatccacttaatggaatactactcagcaatacaaaaggaaaacctagtgttacttgagcaacatggatgaacttcacagacataatattgcacagcacgaggcagacacaaaagtgtgcatatgctatgattccatttacatgagattcaagaacaggcaaagcagatctatggggatagaagtcagaatagtggttacctctggaaggtggaattgactgggaggggcttcagggaacctcctggggtgctgaaaacattctgtgcttgcaccgggtggtggttatgtgggcattacataaaattcaccaagctgcacccttaatgatttgtacaatttgatgcacaaatctaacatctcaagaagaataaattttacaaagtacctaagaagca

SEQ ID NO: 276055 - DNA, 2320 bp, Homo sapiens
tattcttagtaagtttcattcatcaaagcgtgacaaatggtgtcctgggaggaatgcctgggcgccatggggataagatcctgacgctgaggaaaaggatgtaggcacgggcccagcgggccggtctaaatcagaggtccaccttcactgggagggcagtcggagaacccacattgtctgcagactctcacattcaacctaaaacccatgtactcattgcaagccaaacaaaacctcactgaaggtaaaacgtggcccaaggccatgagtttgcaacaccctggacctcaggaaagaattgatcagtaaggtgggctgcttgtgcctgggggtcttctcaccctccgcagaatgcaggcccactccgttgctgaagggcctcctccttgggccagggcgcctgcttctgccagtggcatcatcaccccactcctcagccgccagtcatcagagacacggtctgactttgttaccccggctggagtgcagtggtgcaatcatggctcactgcagccttaacctcctgggctcaagtgatcctctcgccaaggctaggataagtagctaggactacagatgcgccccatcacgcccagctaattttacaacttctgtagagatggagtgttgctgggttgcccaggctggtcttgaattcctgggctcaagcgatcctcctgtgtccggaattggtgggttcttggtctcactgacttcaagaatgaagccgcggaccctcgcgagtctgtatccaccagctactcttccagattcatgaggcaaggcctgcctgctcacctggctggccccaagcacctcttcaacctgttgccaccgtcctgccttgctgcccttctcagctcatccagcagggtctccaagtcgtggaaacagaagcacatatacacacatgctcatatgtacatgcccacagtcacataagcacaccgagaaacaccatcgcagacatgttctcacaagcacatgtgcataacactcactacccctcacgcgtatacacattaatacacacactcatgcacactcagtcttacacacacagacacacagccataatcactgttgttggttgaattgtgcccccccatccccaccaaaaagataagttggagtcctaacccccagtacctggggatgtgaccgtagttggaaatagggtgtttgtagatgtaatcaaattaagatgagatcttactggattagagtgggccttaaatccagtgactggtgtccttataaggagaaaaagatttgaaaacagagacatggagacacagagcagaaggccatgtgatgatggagtcagagattggagtgatgcagctatgagccgagaaataccaaggtgctggcagcccccagaagcaaggagagaggcaaggaacaatctccatcagagcctctggaagaaacagactctgccaacaccttgatttcagacttttggcctccttcactgtgcgagaatacgtttctgttgttttaaactactgagtcaccaagtctgtggtactgtgttatggcagccccggcaacaaatccaatcacacacacacacacacacacacacacacacacacacacacacacagctggctccaggctcagtgatgagctcagaggagttccccttgggagctgctctttctctgtcttccttccttagtgattggtccagtggatccacaaaagctcatggcccagagcaggagcccagtcatttttaattcctcttccctggagttcttaaccatgcgttgccctcaaaatctgctctcaagatttgggttgccatatttaggagcaccagaaaacatacaggaatgctgtgtctgcttgcatcatattaattaaaaactggaaataacctaaatgtcccagaataggtacataaactgtggcatatccacttaatggaatactactcagcaatacaaaaggaaaacctagtgttacttgagcaacatggatgaacttcacagacataatattgcacagcacgaggcagacacaaaagtgtgcatatgctatgattccatttacatgagattcaagaacaggcaaagcagatctatggggatagaagtcagaatagtggttacctctggaaggtggaattgactgggaggggcttcagggaacctcctggggtgctgaaaacattctgtgcttgcaccgggtggtggttatgtgggcattacataaaattcaccaagctgcacccttaatgatttgtacaatttgatgcacaaatctaacatctcaagaagaataaattttacaaagtacctaagaagca

SEQ ID NO: 276056 - DNA, 1261 bp, Homo sapiens
aggcagacaagaggcaggtttttattttagactgtgatgttgaaaattttgtgatcactttttacactgtcccaggacatacagaaccaagacatagtgtcccaagtagtatctaatttcatatactttaggtagttctattccatttccaaaggtttagaataccgccccacctcaacccccaggaaactggggagcactccctccactacacacacttgggacacgaaggacagaccctggttggggaggcacttaggtgtcccttccttaggggctttatctctcacttcccctcctgggttggaggctcctgtgaccccctcgcctgggcaggtccccatgcagggtagagcacttggaggcctctgtaaacatgggttacaggagagagggggcaagaggccacagctggggtacataaggaaacccctctgtgggcccccttactcagagaagtctcaggagaaaccctttcccccacccccagtcctggcaccaagctggagaaagacaaaatggcttgtgaaggcatctgtctgccctccagggtggctgccaggggggcagccatgatggctggcctggtgtgggtgcctttgtgtgccatgactgggtgtctgtttctgcagtcactaggcgcttgttctgtggggtgaggggtgtgggggtgggggcacggcctatggcagggcacgtacgtgaggctgggcacgaaaagcctcttgtcccctttcccagatccaccaagcgtctatgggcagactgttttttcctgcacttcctagtggccagcagagggcgccgccaaaagactgaggccaccacggagggaacaggagaatcggctttttggggtctagccactgtgcagagcccaggcgcgtgggtcggtgtcgggtgtgtgtgtacgtctgtgtgtgtaatgaaactggacgccttccttcccggcgatcttgacttaacctgtcagcagagggcttgaggttagaccacaggttgaacctaggtggctgctggagagggtcacctcattgcccaagatggctgctggagccccagccagcaggaaggaagaagaaagcctgaagaaggacatgccccttcccttcaaggaagcttcctagaagtcacacttatattccattggccagaactcagtcatctagccatacctagctgcaagggaagctaggtagtctagtctttattccatgggggtctggctaaaagttgggaaataaacgaggaatggatatta

SEQ ID NO: 276057 - DNA, 2671 bp, Homo sapiens
gcttcggtctccccaagttctgcccccagtgaggcctcatagctctcctgggactgaggggcagtcccagagggcggcaggagttggcagccagtggtcctggggaccgcgaggtgggtgggtggagggtggcgaagggagggttccgggaccggggagcggcgtcttaattacggcgcgttggcccagcgccgcggagcgccgcggatgacagcggcggtgggtaattagagcgcattagccgtgcccctgcaatcctgtaatttcttctcgcgctcggggtgtgttgtaggaggcgaagcgatgccggcttggctgagtcagactctcggaagcccaggaggggacgcagggggcggcagaggccgcgaagaagggactcccgccgggggaggcgcagacgcagtcctctaggagtcacctgtcccgggctcctcggcgcgcgcgccccgtcggcggcgggaggtggtgggaagggggcgtgacctgcgtctcctcccgccgccgccgccgccgccgccgccgcgcgctctaccggcccgcgagtcctccgcgacatccgggccagcgtctgcacccagccacgtgtcctgcccctggtgcgcaggtggactgctttcctatgtctggggtggagggggtgtcctctctcctccctcaaactggaggcacctagggttaccagatctcaccctccgcagaatgcaggcccactccgttgctgaagggcctcctccttgggccagggcgcctgcttctgccagtggcatcatcaccccactcctcagccgccagtcatcagagacacggtctgactttgttaccccggctggagtgcagtggtgcaatcatggctcactgcagccttaacctcctgggctcaagtgatcctctcgccaaggctaggataagtagctaggactacagatgcgccccatcacgcccagctaattttacaacttctgtagagatggagtgttgctgggttgcccaggctggtcttgaattcctgggctcaagcgatcctcctgtgtccggaattggtgggttcttggtctcactgacttcaagaatgaagccgcggaccctcgcgagtctgtatccaccagctactcttccagattcatgaggcaaggcctgcctgctcacctggctggccccaagcacctcttcaacctgttgccaccgtcctgccttgctgcccttctcagctcatccagcagggtctccaagtcgtggaaacagaagcacatatacacacatgctcatatgtacatgcccacagtcacataagcacaccgagaaacaccatcgcagacatgttctcacaagcacatgtgcataacactcactacccctcacgcgtatacacattaatacacacactcatgcacactcagtcttacacacacagacacacagccataatcactgttgttggttgaattgtgcccccccatccccaccaaaaagataagttggagtcctaacccccagtacctggggatgtgaccgtagttggaaatagggtgtttgtagatgtaatcaaattaagatgagatcttactggattagagtgggccttaaatccagtgactggtgtccttataaggagaaaaagatttgaaaacagagacatggagacacagagcagaaggccatgtgatgatggagtcagagattggagtgatgcagctatgagccgagaaataccaaggtgctggcagcccccagaagcaaggagagaggcaaggaacaatctccatcagagcctctggaagaaacagactctgccaacaccttgatttcagacttttggcctccttcactgtgcgagaatacgtttctgttgttttaaactactgagtcaccaagtctgtggtactgtgttatggcagccccggcaacaaatccaatcacacacacacacacacacacacacacacacacacacacacacacagctggctccaggctcagtgatgagctcagaggagttccccttgggagctgctctttctctgtcttccttccttagtgattggtccagtggatccacaaaagctcatggcccagagcaggagcccagtcatttttaattcctcttccctggagttcttaaccatgcgttgccctcaaaatctgctctcaagatttgggttgccatatttaggagcaccagaaaacatacaggaatgctgtgtctgcttgcatcatattaattaaaaactggaaataacctaaatgtcccagaataggtacataaactgtggcatatccacttaatggaatactactcagcaatacaaaaggaaaacctagtgttacttgagcaacatggatgaacttcacagacataatattgcacagcacgaggcagacacaaaagtgtgcatatgctatgattccatttacatgagattcaagaacaggcaaagcagatctatggggatagaagtcagaatagtggttacctctggaaggtggaattgactgggaggggcttcagggaacctcctggggtgctgaaaacattctgtgcttgcaccgggtggtggttatgtgggcattacataaaattcaccaagctgcacccttaatgatttgtacaatttgatgcacaaatctaacatctcaagaagaataaattttacaaagtacctaagaagca

SEQ ID NO: 276058 - DNA, 525 bp, Homo sapiens
acacacagcaaataggtgaatgatgagacaatttcataattacaaattgcaatgactgctgtgaagggaaagatccaggggctatgagtggagtaactctgtaattcattatccaaactggggcactcttgagagtggaaggaggcatcattaagtattatattggaaaaacaggtgaaaaccagactatgccaggtaagtcaggatccatggtcaccattcaggaaactggactttcatttgactatacagagaagagagacccagaggatcaggacttagccatgcaaagagtctcaaaaaggacaatctgggcagaggaacagagaatcaagaaagtttgtgagttcgaggaactgcaagaaagcgtgtttggaacaaaatgatcaaggcataaagtgatgtcaggtgaggctgaggccagatcactcagggctgtagatcaaattatgcagattggattttttatttctaaatatagtatttggccagtgaaatactttattaagcagggaaggtgataac

SEQ ID NO: 276059 - DNA, 774 bp, Homo sapiens
acacacagcaaataggtgaatgatgagacaatttcataattacaaattgcaatgactgctgtgaagggaaagatccaggggctatgagtggagtaactctgtaattcattatccaaactggggcactcttgagagtggaaggaggcatcattaagtattatattggaaaaacaggtgaaaaccagactatgccaggtaagtcaggatccatggtcaccattcaggaaactggactttcatttgactatacagagaagagagacccagaggatcaggacttagccatgcaaagagtctcaaaaaggacaatctgggcagaggaacagagaatcaagaaagtttgtgagttcgaggaactgcaagaaagcgtgtttggaacaaaatgatcaaggcataaagtgatgtcaggaaagctgtgctttgaaagctcccatctctcaacacgccatccatggccacacaagctgtctgcccaccagactggggtctcttctgttgaacagaaggctgaccaaaagctgacccagcacaaagcccagctttccacaccaacagttactattagctaggctctcaattacagtatcaactttctgaaggaagactagaaaagaatcactctcctcatttccagatatatctgaaacaagggcacagtggtagtcattaaccataaagataaggttaatttgctttccttctaaatctgaatgctaatgtaaccatttaaatagtgccaacaatggaaataaacacaaggctgagttaaaccac

SEQ ID NO: 276060 - DNA, 1265 bp, Homo sapiens
cggacgcgtgggtcgacccacgcgtccgggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276061 - DNA, 895 bp, Homo sapiens
ggtttctgctggaactacctttgttaaattgcaattaggtatttttctttggcttactttgaagctgtggctaaaaatagttgcaaattacaaagctcatgcaggatctactctggggctctcgttgagggtattgcccactaaatcacacagtgcctctttaggagaacccatagaagagattttactctggtcttagtaccaagagatgccattcttaggagaaagtagtttgtttttgtcttttggacataattgcaaatttttgttattggttctatttcctctttgcttatgctaggaaactcagagccatatgtgaaagcatttttatttactaaaccccctggttttatttcgttttctttgccttccttttcctcccctcctcattctttcctccagatgcataagatgcctgacctatttatcattggcagcggtgaggccatgttgcagctcatccctcccttccagtgccgaagacattgtcagtctgtggccatgccaatagagccaggggatatcggtatgtagggccccaggaggcagggtcaatggatctttttagtttttaactcaaaagctattttaagaatcacatactgccttcacaaaagttttatttagtagaatcaaaaataacattctcctgttaacaggctcaatatttatgcttagaaatgaaacaacttaatgagaaaacatagcagaaagaaatggcttgtacatacaacatatagaatgcgtgtgtctattgatcatagaaacttcaagttaggaaggattctggaaaatatttagaccaatccctcgttttatagatgaaaaggttgagacccagagaggagaggtgaccaccccaaggccccactgtcagtcgagcagagcgtca

SEQ ID NO: 276062 - DNA, 693 bp, Homo sapiens
acctgtccctgttgggtcacctccttggatcatgaagtctttgataattctgtggaattttgtgccattgtagtaacctcgacgagccaactcagcaaagttcttacaggtctttggagcatgcagcggagtacagctccagcacaatgattcccatgctgcagagggagaggacaacagctccagtaaacaaaaaggtcagggcagacaggagtattatggaactgctccaggactcttgattttcaagcttgtaagtcatgaaattgtgataaccactggatttcatgctcagcaaaggaaaacaccacaatgcaagtaacataaacacccattatcttttttgagtaaaacacgcaggtgttctgggtacttcttttcagcaaaataacaagcatggagaactcaaaattctaatactatacatatatacatatgtatatatatatagctatatctgattatctgaaaccaatataaccaacccctaaattaggaaaaaaattcttacacttaatttttaattttttaaaaaaagagacattaaaatatcaggagttcatatttatttagaagtttctgggtgggggtagggactgggtagatggaaaataggaagatgtttaatgaataccttttaaaaacttttgtatttttgatccatgtaaatacattacctattcaaaaaattta

SEQ ID NO: 276063 - DNA, 4361 bp, Homo sapiens
ttctgttttgggcggaagcgctggacgagaggaggaattactctagggtacaaggcctcgccccaggagtggggggttgcttccgggtcgcgctcccggaaacaggaagttgcccatcctcctcgcccggcggcagctgtccccgaggcgggaggagcccgagggggcgcgagccccgcatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276064 - DNA, 4557 bp, Homo sapiens
ggccgctgagggaaagggaacccagaaggctggcatgccagcaaaagagtaagaatttcttaccagtcagatttttggcttctctctctctgtgcaaatggttgaatgaatgaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaaggaatcattgtagtcaatcattttccagttctcagccgctcagttgtgatcaagggacacgtggtttccgaactgccagctcagaataggaaaataacttgggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276065 - DNA, 4485 bp, Homo sapiens
ttctgttttgggcggaagcgctggacgagaggaggaattactctagggtacaaggcctcgccccaggagtggggggttgcttccgggtcgcgctcccggaaacaggaagttgcccatcctcctcgcccggcggcagctgtccccgaggcgggaggagcccgagggggcgcgagccccgcatagatgggatctcgttctgtctcccaggctggagtgcagtggtatgatcatagctcactgcagcctcaaactcctgggctcaagcagtcctcccacctcagcttcccaggtagctgggactacagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276066 - DNA, 4723 bp, Homo sapiens
acctgtccctgttgggtcacctccttggatcatgaagtctttgataattctgtggaattttgtgccattgtagtaacctcgacgagccaactcagcaaagttcttacaggtctttggagcatgcagcggagtacagctccagcacaatgattcccatgctgcagagggagaggacaacagctccagtaaacaaaaaggtcagggcagacaggagtattatggaactgctccaggactcttgattttcaagcttatggtgtcaggaatgggatctaaagtggagcttctagcgacccccaggagcactgagtgaacatgcaaggtacctgcaggatccacttgtgtctattgatctctcacagcagctggggatcacagaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276067 - DNA, 4232 bp, Homo sapiens
gtatcttgaggatcccctggaaaccgcccatggtagacacgagcctcgtaatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276068 - DNA, 2359 bp, Homo sapiens
ttctgttttgggcggaagcgctggacgagaggaggaattactctagggtacaaggcctcgccccaggagtggggggttgcttccgggtcgcgctcccggaaacaggaagttgcccatcctcctcgcccggcggcagctgtccccgaggcgggaggagcccgagggggcgcgagccccgcatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctga

SEQ ID NO: 276069 - DNA, 4302 bp, Homo sapiens
ttctgttttgggcggaagcgctggacgagaggaggaattactctagggtacaaggcctcgccccaggagtggggggttgcttccgggtcgcgctcccggaaacaggaagttgcccatcctcctcgcccggcggcagctgtccccgaggcgggaggagcccgagggggcgcgagccccgcatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276070 - DNA, 3995 bp, Homo sapiens
ttctgttttgggcggaagcgctggacgagaggaggaattactctagggtacaaggcctcgccccaggagtggggggttgcttccgggtcgcgctcccggaaacaggaagttgcccatcctcctcgcccggcggcagctgtccccgaggcgggaggagcccgagggggcgcgagccccgcatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttctctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276071 - DNA, 3454 bp, Homo sapiens
tcatcttgggcctgtgttatctgaactttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276072 - DNA, 1515 bp, Homo sapiens
ttctgttttgggcggaagcgctggacgagaggaggaattactctagggtacaaggcctcgccccaggagtggggggttgcttccgggtcgcgctcccggaaacaggaagttgcccatcctcctcgcccggcggcagctgtccccgaggcgggaggagcccgagggggcgcgagccccgcatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggtatgtagggccccaggaggcagggtcaatggatctttttagtttttaactcaaaagctattttaagaatcacatactgccttcacaaaagttttatttagtagaatcaaaaataacattctcctgttaacaggctcaatatttatgcttagaaatgaaacaacttaatgagaaaacatagcagaaagaaatggcttgtacatacaacatatagaatgcgtgtgtctattgatcatagaaacttcaagttaggaaggattctggaaaatatttagaccaatccctcgttttatagatgaaaaggttgagacccagagaggagaggtgaccaccccaaggccccactgtcagtcgagcagagcgtca

SEQ ID NO: 276073 - DNA, 4461 bp, Homo sapiens
ttctgttttgggcggaagcgctggacgagaggaggaattactctagggtacaaggcctcgccccaggagtggggggttgcttccgggtcgcgctcccggaaacaggaagttgcccatcctcctcgcccggcggcagctgtccccgaggcgggaggagcccgagggggcgcgagccccgcatgaatcattgtagtcaatcattttccagttctcagccgctcagttgtgatcaagggacacgtggtttccgaactgccagctcagaataggaaaataacttgggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276074 - DNA, 4667 bp, Homo sapiens
acctgtccctgttgggtcacctccttggatcatgaagtctttgataattctgtggaattttgtgccattgtagtaacctcgacgagccaactcagcaaagttcttacaggtctttggagcatgcagcggagtacagctccagcacaatgattcccatgctgcagagggagaggacaacagctccagtaaacaaaaagatggtgtcaggaatgggatctaaagtggagcttctagcgacccccaggagcactgagtgaacatgcaaggtacctgcaggatccacttgtgtctattgatctctcacagcagctggggatcacagaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276075 - DNA, 4784 bp, Homo sapiens
acctgtccctgttgggtcacctccttggatcatgaagtctttgataattctgtggaattttgtgccattgtagtaacctcgacgagccaactcagcaaagttcttacaggtctttggagcatgcagcggagtacagctccagcacaatgattcccatgctgcagagggagaggacaacagctccagtaaacaaaaaggtcagggcagacaggagtattatggaactgctccaggactcttgattttcaagcttgtaagtcatgaaattgtgataaccactggatttcatgctcagcaaaggaaaacaccacaatatggtgtcaggaatgggatctaaagtggagcttctagcgacccccaggagcactgagtgaacatgcaaggtacctgcaggatccacttgtgtctattgatctctcacagcagctggggatcacagaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276076 - DNA, 4457 bp, Homo sapiens
ggccgctgagggaaagggaacccagaaggctggcatgccagcaaaagagtaagaatttcttaccagtcagatttttggcttctctctctctgtgcaaatggttgaatgaatgaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276077 - DNA, 4326 bp, Homo sapiens
ttctgttttgggcggaagcgctggacgagaggaggaattactctagggtacaaggcctcgccccaggagtggggggttgcttccgggtcgcgctcccggaaacaggaagttgcccatcctcctcgcccggcggcagctgtccccgaggcgggaggagcccgagggggcgcgagccccgcatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276078 - DNA, 3165 bp, Homo sapiens
  misc_feature (2952)..(2952): n is a, c, g, or t
  misc_feature (2956)..(2956): n is a, c, g, or t
  misc_feature (2961)..(2961): n is a, c, g, or t
  misc_feature (2999)..(2999): n is a, c, g, or t
  misc_feature (3059)..(3060): n is a, c, g, or t
  misc_feature (3104)..(3104): n is a, c, g, or t
  misc_feature (3131)..(3131): n is a, c, g, or t
ttctgttttgggcggaagcgctggacgagaggaggaattactctagggtacaaggcctcgccccaggagtggggggttgcttccgggtcgcgctcccggaaacaggaagttgcccatcctcctcgcccggcggcagctgtccccgaggcgggaggagcccgagggggcgcgagccccgcatggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggaggagacctctgaacagatcacaaatgttacgtgagctttttcctgttttcactcacctgccatttccaaaagatgcctctttaaacaagtgctcctttcttcacccagaacctgttgtggggagtaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaaaagtccaatggttgtttaaancaantttangaatttaaaggagggttttaaagtccagaaggggaatnaatctgggaagggcccgggcttttggtggcaaagcctttttaacaagcccttcctgcaanntggtccccttaacccctgggccttgttacaattggggggaaaangggcctaatggtttttaaaacaaaagntggcttttaaaaagggccctcctgaaaaagtttt

SEQ ID NO: 276079 - DNA, 3741 bp, Homo sapiens
ggtttctgctggaactacctttgttaaattgcaattaggtatttttctttggcttactttgaagctgtggctaaaaatagttgcaaattacaaagctcatgcaggatctactctggggctctcgttgagggtattgcccactaaatcacacagtgcctctttaggagaacccatagaagagattttactctggtcttagtaccaagagatgccattcttaggagaaagtagtttgtttttgtcttttggacataattgcaaatttttgttattggttctatttcctctttgcttatgctaggaaactcagagccatatgtgaaagcatttttatttactaaaccccctggttttatttcgttttctttgccttccttttcctcccctcctcattctttcctccagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtacaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaaaagaaaaaaaaa

SEQ ID NO: 276080 - DNA, 410 bp, Homo sapiens
gaaagtgaaagaaactggaaactaaccgactcctattggaaacaaatgccgctgccagggtgaagggctgttgctggccaactctggcaggaacaggaagcaaacagagaggagccggtcccctctcccaccctgtccttccaggctccctatggtgtccccttgtcagcagagacacttagtaaactagcagtgctgtttacagagtccggccctctccacacaaagcggtgtgtaggagggagtgtttggaggggagagacaatggcttgataacaggcatggtcccaaatacgctaggtgacaatgactctcatgttctgaagctagttgctagactacctcagcaggacttgcagaagaaatgactgaaatgttttttattgtggtaaaatatgcataatataaaa

SEQ ID NO: 276081 - DNA, 492 bp, Homo sapiens
aaggtggaccagggatacaagacagtaccagaaaggccttggcacaggagaggggaaggaatagatccttgcagccaagtgatttagaagactccagaggagagtatatctgcagtaagaagcccaccagcccctggagtttgattctagctgattaagaggcacccaggacctgtatttcagcaagacaaccaagaaataagccaagggaaaatgttaatctgtgtgccagggattcccaacaatgcagttccagaccagccccaaacatcctaattcagacccagtgtgtgggaacttgcctgggtgggagcaggaggagggagtgggggaagcaggaagaaattaggcttgcacaaacttagtaattgaaatcattaatagcagtaaaataagttgtctgtcctacatgtaatttgtagtaatgtttcgttactgagattaatttctagtaatgaaatactaattaaaccatttattgagtaatgtatt

SEQ ID NO: 276082 - DNA, 508 bp, Homo sapiens
cctgtatcactcgagaagccctgtatgtcacatttattattccttttagacacatcctcagccaagtgtagtaaatgtccacactccctccctgcttccctcccttccttccctcttttttcaagaagaggaggtttgtgttgccttcagatgactgttgatttaattgacaggcagcttttcttcattgtgtgctttttgctattgctcacaaaagtgcattcactattctatagtatgttgaaacttttaaatggaaacggcttttcattaacaaaggaagcattttcttccccccttccatgccttagctttctccgctaagtcttggcttcttcagcagctgtacctccaccagaaatgacaaaaggtgcaattgtgctaggagatggcgatgaagatatgccagtggagttttgtgtgtgggctgctggggactgttttccttctgtgtttggttttgttttatttttgttattccagaaagttgagagcacatctaaaaacc

SEQ ID NO: 276083 - DNA, 896 bp, Homo sapiens
  misc_feature (204)..(204): n is a, c, g, or t
gagagagtgtcagttccccaagtagcaggggcagcctggtattgtgtgcatgccagagttaggaacctgccttcctagttctacctttttggtgccatcttcagagaagtgctgggcttccttctagcatggcagcagtagccttcaaggcagaaggccagcaaagcaatgctgaagttcctgcatttgtggaacccacatccntcccaactggggcctgcctgtcttttctggactgttccaaagttgcataccagcacttgccgcgctcgctcggtctcccatttaagactggctttgatctcactgacagtcacgtagccattcttctgaaggaaggaggaatggggattgaatcagttaagagtgcaccttcccttagaacccaggatctgcccaggaacaagagacttacccagacaggaggaaaagctgtcaagcatgagagaacacagaaaatgtttaaaggttccagcggggagagagagaagtgactttcagcatgacagagcctggcccagtgctttgcactgtagctgctcaataaatgtctgctgaacaagcacaggcctgagtagttcatccactggatagtctcagcaaaagacctgcataatggggagcacgagctgagaactgctccagacttgcctcacagactgtcccttgcacacacacacactcgaaggtgcaccagtacctctgccagctgcagcaccacggtgtgatccatattgagctcagctggaacagactgaatgagagaagtccagagtccagttcacaggacctagccaccctcacctccattccgatgcttcagcgccaggcacacttcgataatttggacacctagttcgtaatagaagtcccccacgcccagcatctcagaccaa

SEQ ID NO: 276084 - DNA, 2012 bp, Homo sapiens
  misc_feature (204)..(204): n is a, c, g, or t
gagagagtgtcagttccccaagtagcaggggcagcctggtattgtgtgcatgccagagttaggaacctgccttcctagttctacctttttggtgccatcttcagagaagtgctgggcttccttctagcatggcagcagtagccttcaaggcagaaggccagcaaagcaatgctgaagttcctgcatttgtggaacccacatccntcccaactggggcctgcctgtcttttctggactgttccaaagttgcataccagcacttgccgcgctcgctcggtctcccatttaagactggctttgatctcactgacagtcacgtagccattcttctgaaggaaggaggaatggggattgaatcagttaagagtgcaccttcccttagaacccaggatctgcccaggaacaagagacttacccagacaggaggaaaagctgtcaagcatgagagaacacagaaaatgtttaaaggttccagcggggagagagagaagtgactttcagcatgacagaggtaggttggtgggttcaatcctaaaactggggtaccggccaggcacggcagctcatgcctgtaatcctagcactttttgggaggccgaggtgggtggatcacctgacgtcaggagttcgagaccagcctggccaacatggtgaaaccccatctctactaaaaatacaaaaattagccaggcatggtggcacacgcctgtaatcccagctactcgggaggctgaggcagaagaatcactggaacctgggagatggaggctgcagtgagccggagattgcaccactgcacaccagcctgggtgacagagcgagactccatctcaaaaaacaaaaaagtggggtcccttgtactaacatactgagttagacttctgcaaagcactctagagcatgacaagggaagattctggacaattaattgatgggaagaaatgatgataatcataaactgctaataacctccattatttaaatattcagcccttgccctgcctcattctactcatcctccaatacagaaaagcccctcccttatttagttctgttttacgtcataaaggaaactgggccgggtacggtggctcacccctgtaatcccagcacttagagaggctaaggtgggtggatcacctgaggtcgggagttcgagaccaaactcaggcctggccaacatggagaaaccccatctctactaaaaatacaaaattagctgggcgtggtggcacacacctgtaatcccagctactcgggaggctgaggcaggagaatcacttgaacccgggaggctgacattgtagtgagctgagatcacgccattgcactctggcctaggcaacgagtgaaactccatctcaaaaataataaaactgaacacatctaaatacctgatggggatttgggggaagatggcatatgcttaaggcatgatgagggatgggggcatggcaaacaagattttttaaaatctgtttttgaagaatccataaagtagtttcaaaagacatcaaagagtctggctacccaaagaaatctagttagttgtctgcatgtctgtctacctgactagactgtaagctccttgagagcaggaattttatcatctttatatgccccacagcctggcccagtgctttgcactgtagctgctcaataaatgtctgctgaacaagcacaggcctgagtagttcatccactggatagtctcagcaaaagacctgcataatggggagcacgagctgagaactgctccagacttgcctcacagactgtcccttgcacacacacacactcgaaggtgcaccagtacctctgccagctgcagcaccacggtgtgatccatattgagctcagctggaacagactgaatgagagaagtccagagtccagttcacaggacctagccaccctcacctccattccgatgcttcagcgccaggcacacttcgataatttggacacctagttcgtaatagaagtcccccacgcccagcatctcagaccaa

SEQ ID NO: 276085 - DNA, 2265 bp, Homo sapiens
  misc_feature (2171)..(2171): n is a, c, g, or t
ctgtgaatgtggttcgctattggattcatcatgggataaacaaaagaactcttgtaatgcagaatcattggggacttccatgccatcagaaactggtgttagtgcttgtgtctctttttctccaactagtctttgttgtgatccatctgtgtactcactggtgacctttcctctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctcttgtcttcaccatccagaccagggggactgcggagcccatcacggtcaccattgtgcctgcctacagagccctggggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcagtatgtgaaagccaggtcccccagagccaatctgccccctctctatgctcttgaacttctaaccatctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcatagggagaccccgtctctacaaaataaaaaaataattcactgggnaaaaaaaaatcattttattatataatattattatatttaaaataaaaacctcgaggggggggcccggacccaaattcgccctatagtgagtcca

SEQ ID NO: 276086 - DNA, 1760 bp, Homo sapiens
  misc_feature (1666)..(1666): n is a, c, g, or t
ctgtgaatgtggttcgctattggattcatcatgggataaacaaaagaactcttgtaatgcagaatcattggggacttccatgccatcagaaactggtgttagtgcttgtgtctctttttctccaactagtctttgttgtgatccatctgtgtactcactggtgacctttcctctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctcttgtcttcaccatccagaccagggggactgcggagcccatcacggtcaccattgtgcctgcctacagagccctggggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcagtatgtgaaagccaggtcccccagagccaatctgccccctctctatgctcttgaacttctaaccatctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggcccatcatcctggatccggccgaccccaccctcaacgtggcagaagggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcatagggagaccccgtctctacaaaataaaaaaataattcactgggnaaaaaaaaatcattttattatataatattattatatttaaaataaaaacctcgaggggggggcccggacccaaattcgccctatagtgagtcca

SEQ ID NO: 276087 - DNA, 511 bp, Homo sapiens
ctgtagcaatcatgtttctatctatctatatatatctcataatgttatgctgtaaatctcaaatatatacaataaaacttgttaaaaaaagaaaactaacatagtggaaattctgttttgattgcaattctgtatctgctaactttttgtgtctaagaaggggacaatccatagcaaaaacaaactgacaaatacttttccttcctggtaatcccacacttatggaagttaagaaatttatcttgcttcagtgttaagaaatgactttttattttatttttcttaagagatagctttttaaatgtttgtttttagtgtatctgatgaaattacagactatatctattaaaatagcaagtgttatatatgtgtatgttatttggtcacttgatataaaagcaggtttatggcctgaaatgaatactttttacctttccatccctggtttgggcactagtagctgcctcaaagaacagtcatattcaaaagcaagtcttggcagaatgctcat

SEQ ID NO: 276088 - DNA, 1141 bp, Homo sapiens
aggtcatctagggcgaaattccagtctgagccctgagcagtgacttaagttttcccgataaggctcaagaagggacacagattgtcctccccacaccccgcactctgtcagcacctccactctggtgaagcctctgctgcagacagcccggctcgagaagagacaaagatagacttgggacagataaggacagagacagccagggagagaggggcaaggagctcagagaataatgctgtgtgctccctctttgcctgctactgaacaatgacgtctcttgttgtgaaccccactggcagagcacggaccatggaagcatcttttggcagcaccagagaactgagcatctcaaaggagttcttctgtttcttctgcgtgggttgaccatgggcatcaggcatcagagatacaactctggatcttgtccatccattgctgggcactctgtccatcctgggcgcagaagttatacacacgtttgctggtcttgagctacaaaaccaaatgacagtgaaccagagatgaagggcagggctgttttatggatttggggaaacagatccagatggaggaaacatctgataaagtttgcctaagcagccagcagtctatcaatcatgactcttccaaccctcatcctgcatctatatctagattcaaagaagtccatgcaggaggcagtctacacttttcaagagaaaatggaaggacttcagagttgatttgatgaagctcagtaaaaaacataattttatgtttctcttttaagttgttggctgtttgtttattatgaagccatttaaagagttttcttgtttagcagtgtatatatactgcagatcatggttactgagactctagatgacagaagcgtgtagtctgtgtccttgggtgacttaaaaataaaagcagaacttttatacctttttcaaatagtcaatctattactaacatgagcccactttgtttttaatagggaggaaaatgtgttggggtgaggcaaaaagtagttctttaaaaggccatgaagggtgtctcagcagtggtgtcttgcttggaatgaagtgacatagtcaaaatcaacatgcattttaccagtttatcaaaaaaaaaaaaaaaaaaagactcaagcccaagatgg

SEQ ID NO: 276089 - DNA, 676 bp, Homo sapiens
ctgtctctcctctcaggcatggtatgagcagggctaagtggaaaaaactgtatctatctttcatgttaaagaagtccagaagactgggaaacagatccagatggaggaaacatctgataaagtttgcctaagcagccagcagtctatcaatcatgactcttccaaccctcatcctgcatctatatctagattcaaagaagtccatgcaggaggcagtctacacttttcaagagaaaatggaaggacttcagagttgatttgatgaagctcagtaaaaaacataattttatgtttctcttttaagttgttggctgtttgtttattatgaagccatttaaagagttttcttgtttagcagtgtatatatactgcagatcatggttactgagactctagatgacagaagcgtgtagtctgtgtccttgggtgacttaaaaataaaagcagaacttttatacctttttcaaatagtcaatctattactaacatgagcccactttgtttttaatagggaggaaaatgtgttggggtgaggcaaaaagtagttctttaaaaggccatgaagggtgtctcagcagtggtgtcttgcttggaatgaagtgacatagtcaaaatcaacatgcattttaccagtttatcaaaaaaaaaaaaaaaaaaagactcaagcccaagatgg

SEQ ID NO: 276090 - DNA, 708 bp, Homo sapiens
tggctatagagcgtggctgctcttcgctccactccattggatggggagatgctggaattctgttcctcccccatgctgctgtctgggagatgtagcagagacctcttctgataggaagggaaacagatccagatggaggaaacatctgataaagtttgcctaagcagccagcagtctatcaatcatgactcttccaaccctcatcctgcatctatatctagattcaaagaagtccatgcaggaggcagtctacacttttcaagagaaaatggaaggacttcagagttgatttgatgaagctcagtaaaaaacataattttatgtttctcttttaagttgttggctgtttgtttattatgaagccatttaaagagttttcttgtttagcagtgtatatatactgcagatcatggttactgagactctagatgacagaagcgtgtagtctgtgtccttgggtgacttaaaaataaaagcagaacttttatacctttttcaaatagtcaatctattactaacatgagcccactttgtttttaatagggaggaaaatgtgttggggtgaggcaaaaagtagttctttaaaaggccatgaagggtgtctcagcagtggtgtcttgcttggaatgaagtgacatagtcaaaatcaacatgcattttaccagtttatcaaaaaaaaaaaaaaaaaaagactcaagcccaagatgg

SEQ ID NO: 276091 - DNA, 255 bp, Homo sapiens
gtaaaaaaaaaaaaatcaagaaagatctaaatagatgttgagatattccatgttcatgaataggaagactcaacattattaagatgccaattcttcccaacttgatctgtagatacaaaacaatctcaatcaaagtcccagcaaattattttgtgactatcaacaatcagaatctaacaaagttggaagactgacgttttttaactgcaagacatactataaagctatagtaatcaaagtcttatggtatgggtg

SEQ ID NO: 276092 - DNA, 299 bp, Homo sapiens
gaaacaatgagattggattattcttctgcccacccactgggcatttggagctcagtgctcacagaagtgagttgacagaagtcaattcacttgaataggctgcacagcaccttctcttctttcatgagccccaagaacacatctaacaactgggcacatcaggggagagtgacccagaaccaaattccatgcttgctgtagtcatttttatatttaaacccagtttaatgtcttaatttcaattcctggggattcagattctttgcgttgggtttagattcatgccttggggctttttt

SEQ ID NO: 276093 - DNA, 147 bp, Homo sapiens
tgattggtgccttctgggttaaaaggagtgaccaataatttatctagacagagaataactcaaaaacaaggcagggcttgaattaagtcttgaaagaaggtacatatggaggaataatgagaggtttggagagataggtagtttagg

SEQ ID NO: 276094 - DNA, 730 bp, Homo sapiens
gtgctctgatgacccacgacccctcctctttcagctgacttctaacttatgcaacaacagaaattaaattgatgggcttttaaaattaattggttacaataatatactcatattttcagtgctattttatccaatttttggctttatatatttctatcctctatacttctccaatacttgtcttagcttgtttttcattttctatcttaaactcttgacaatattttcattttctatcttgtatctatcttccaattttcttctaagtatgtacattttgcccttagctttttgtttcctagcttgtcttttttcttctgcttcctacttttcaggtttaaatttaacttttttcttctaaaagtatgtttttatctactaatttccctatcttctctattcttttcttcttttcccgagttgcagagttcaaagccttgaagtcatactggatgcttcttttcctctcacacctcacatctgacctatcagcagatctgtctgattaaccttcagcatatgtccagaatctgaccaattctcaccacttccactactaccactgctgtcttttacctaaattactgtgggaacctccaaactagtctcccagcttccatctttgacatgttgagattcttctcaacacagaagcctgggccaggcacagtggctcatgactgtaatcccagaactttgggaggccaaggcacaaagatctcttaagccc

SEQ ID NO: 276095 - DNA, 476 bp, Homo sapiens
gtctgcatgtctcccctataccccagattcacatatccagctgcctccttaatattatcacttgaataaaagacatctcaagtttaacaagtcctaaactgaactcctgattgctgcttgtcactgccctaccaccaaatcctgttccttttcttcttttcccgagttgcagagttcaaagccttgaagtcatactggatgcttcttttcctctcacacctcacatctgacctatcagcagatctgtctgattaaccttcagcatatgtccagaatctgaccaattctcaccacttccactactaccactgctgtcttttacctaaattactgtgggaacctccaaactagtctcccagcttccatctttgacatgttgagattcttctcaacacagaagcctgggccaggcacagtggctcatgactgtaatcccagaactttgggaggccaaggcacaaagatctcttaagccc

SEQ ID NO: 276096 - DNA, 452 bp, Homo sapiens
tcatgtacatttacctgtcagtactcaactgaagattctaaataaactatgtgccacaaatctccaaatgtttctctttgaatctttctcttcttgttaacatgccacggaaattttacctcctttggtctcacagaccctcaggtttgtatgatcatctcagggaagcttctattagctacctgtgttctccctctccgtgctacagcctggcaactttctacaggctgtgaactgtggtaatgtagggataacttggtttgtttcccccctcccaagaatcactgcactgtattatatcatgtccagtgtcaaaaacaattgcttttgcttttatttttttctcattgtttcaggtgaaagaataaaatagtttctgttattccatttatgccagaagcagaaatcatatttataatttaaaaataaactgatgtattccttaacccaca

SEQ ID NO: 276097 - DNA, 628 bp, Homo sapiens
ctgccaccaccaattgggaattattcataactgtaatagctgacacttactgagagtttattatgtgccggcactgcctcaaaaatattacacgaattaacacaaataatctgtctggtcctaacaatagtaccatgaggtaggttgtggtaatagtgatagctaatatagctcctagtatgtaccaggcacagttttaagcatgttacagatattaactcattgaattcttatcatagattcatgaggtagatactgttattatctctaattgataggtaagaaaactgaattacagagagattaagttacttgctccacgtccctcggttaaaacctgcctcccgggctgggtgcagtggctcacacctgtaatcacaacactttgggaggccgaggtgggtggatcatgaggtcaggagttcgagaccagcctggccaacatagtgaaaccccatctgtactaaaaatacaaaaattagctgggcatggtggcgggcacctgcagtcccggctacttgggaggctgaggcaggagaattgcttgaacccgggaggtggaggttgtaatgagccaagatcacaccacagcactccagcctgggcgacagagtgagagtctttctca

SEQ ID NO: 276098 - DNA, 458 bp, Homo sapiens
aaatgtcgaatccctgccagcaatcactgtcctcaccaatcactggcttctttgcaaatcctaagagagaacattcagtgttaattatcatcttaaagtttatgcttctctaaaggtttgtcttgtctaccctgggttgttaaaaactccacgaggggtaaccagcaactgcaaaaacatacaaaattgtaaagaccattgacactatgaagaaactgcatcaactgaaggacaaaataaccagctagcatcataatgacaggatcaaattcacacataacaatattaaccttaaatgtaaatgggctaaaagccccaattaaaagacacagaatggcaaattggatagagtcaagacccattggtctgctgtattcaggagatccatctcacgtgcaaagacacacataggctcaaaataaaaggataggggaatatttaccaagcaaatggaaagc

SEQ ID NO: 276099 - DNA, 281 bp, Homo sapiens
accctgtctctactaaaaatacagaactgacaactcagctgtttcctgcattccttgagcatgttcactgtcagtctatgtggaccgccttgaccaggttcaagagttccttttcattccagtttattgagactttttcttttttgagtcggagttttgctcttgttgcccaggctggtgtgcaatagtgcaatctcagctcactgcaacctccacctcctggattcaagcgattctccagcctcagcctcccgagtagctgggatgacagccacccgcca

SEQ ID NO: 276100 - DNA, 396 bp, Homo sapiens
tgtgtactatatcatactgttcctcaaaacaatccagtgacttccaattttatttagaataaaatttcaaattctttttatggtttatcaagtattacctgcctctctaattgttcttacaatgtttcagcttcaattattttctttgaactcctgtaatacaccaaggtctttaccagctcggagcctttgcacaagctgttctttcttcctgaaatgctgtttccctgaagtcctttcattattggttctttcttagcatttggacctctgttcatattatctggtcatgctcttgaaatagatgtcccttcaatcccacagaaacatgtaatttttccatttttgataatttgattgcttcttaattctcaacagaattggtgattttgcttt

SEQ ID NO: 276101 - DNA, 531 bp, Homo sapiens
ccagaggctgtgtttttgccctttggtcatgcagatggggctaaagcgaagttacaacattggaaaatgtcttcttaacgtcacactgatctccttaaggcaacgagccccacatgctctctgaggcctgtgcacgtgttctgaggacccagttatgtgctgcgtgattccagaggtgaacagaccctcacagatcacctctcctcaccctctcatgagagggaaactgaggctcagggggagaattggcaaaggttacacttggtggtgggtttggaatctgccctgtggacgcccgactaaccatttctgccagatgcgcgtgggaagtaaaatgggaagaggtgctccataggaggaggggacgtgggtacagtcacgtggacccgtgagccggtcacctgcgaggcaccagggcctacaggaaaggtgcccgctgtcggcttccgcagggaatttcgttatctttgtgaggtagggtggaacttgcatcctgaacattaaagtttacatgccaaggaaaaaagtgga

SEQ ID NO: 276102 - DNA, 400 bp, Homo sapiens
ctggatagttaccagcaaacagtgtggttcagaaactaattctaaattcgtatgtggttcttgaaggcccagaaagaggaaaaatagaaaatagtagaggagtttctgactgagttatcatacagcaaagcctaggaggttgaggggattgaagggaagaagtggccgactctgccacgttggggttagggaaatagggagtgtcaccaaagaggacactgcagttatctgagttaggtggtctggagggaggacattttccagagtccaggagaacacaagtcaaagtcataatcatccatctctcctatgttgggttcataccattagataaagtatgataatatcacaacaatttaggtcagaggttcagaggttctctgaaatgaaccatttcata

SEQ ID NO: 276103 - DNA, 110 bp, Homo sapiens
gcttccctataatagaggattttttattctctttgagtatgagggtgcacagcacacacacacacacacacatacacacacacctgttttgtattcaaactgagaatgtt

SEQ ID NO: 276104 - DNA, 3110 bp, Homo sapiens
  misc_feature (739)..(739): n is a, c, g, or t
  misc_feature (1387)..(1387): n is a, c, g, or t
  misc_feature (1877)..(1877): n is a, c, g, or t
  misc_feature (2026)..(2026): n is a, c, g, or t
  misc_feature (2046)..(2046): n is a, c, g, or t
  misc_feature (2084)..(2084): n is a, c, g, or t
  misc_feature (2144)..(2144): n is a, c, g, or t
  misc_feature (2228)..(2228): n is a, c, g, or t
  misc_feature (2360)..(2360): n is a, c, g, or t
  misc_feature (2479)..(2479): n is a, c, g, or t
  misc_feature (2482)..(2482): n is a, c, g, or t
  misc_feature (2484)..(2484): n is a, c, g, or t
  misc_feature (2486)..(2486): n is a, c, g, or t
  misc_feature (2728)..(2728): n is a, c, g, or t
  misc_feature (2754)..(2754): n is a, c, g, or t
  misc_feature (2781)..(2781): n is a, c, g, or t
  misc_feature (2815)..(2815): n is a, c, g, or t
  misc_feature (2821)..(2821): n is a, c, g, or t
  misc_feature (2956)..(2956): n is a, c, g, or t
  misc_feature (2997)..(2997): n is a, c, g, or t
ctctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgtaccaaaaaaatttcatatcaaataatattttcctgtagtgcattcaaggatctggttccacagcaaaaaattgttttggtctcagttcctcaaaatcacatttaaggagcttgagatttatattttctacttaataagtcttacaaaagcaagttaagaaggaaaatggacaatcatttctgcacatatagggtttaataaaacatgtataataaaatatctcatattttaaatttccaccttattggtagctttcatgacaaagggctagggtgctgatggccatacaattaaggtttttggttagttagttagcagaactaactgactcctacctggtgggtttttcttttgtttggttggttggttggttggttttttcccagatggctcaggaggaaggtaaatagcagtcattgtatgtgtgacagagtttgagatagaatgagcatattgaatctcacatcctattcttattactgtcaggcagcgntgacctagcagtataaaactatctgaagcaatgtagtcactcagttctcataaagtttatttcaagtactgtaacaattcatgtttggattagaaaagtcactagaaatttgacttccatatagtaatctatacttttttctctcatttccttcattttttgagccgtaagtgtaaggcattttgctggtattattacaatggttatgaggagtttctttgcttgcccaaggtcacatagctagcaagttaaagtagattcaaatccaggcctgctagataccaaattattatttaagagtacttttcactactcctaaataatgacacagatacgtttgtcttacacatttcactttattgtcaagttattagtatgtttattttcaaaagttattttttgcaatttctttttattattccgtactttttaaatttacttcattatcacgtcttcctttattctttttaaatagtttttgcttttgttattttgttttcccttttttactcttggtttgtaatacctctttccttatttgctcctttctcatttgatctcaatgttaatccaactgttttccacatctgattcactaaaattttagcccttaaaaaaaaaattcctgtttttcctatctccttttgnccattctcttctccttgcctcacttcttttatctttttccattttactttcattttttgtttctctagatgttgttttgacatatgagttaatgtactggtacaattttgcatctgtaaattagagcttcagaatcaactgagtgtatttattctttatttttaggcctaaatttatcttaccttttattgattttataatatactatactctttcattttagtctgcatatgttagccaaagaagatatgcccctgttttaagaaatctctgtaaaaaatgtcaagtgtgacaagaattcttcaagaaacaagctcctctagtttgtcttctatatttagagcttcaacagttacctatattactggtaactcccaaatataccttcaaacttgttttttgggcccaagttttttgcttcatatatatctgttttgaatatcccataaataattgcatctaaagcatacctccactccattgttctcanagataaaaccaaacctgtgctgcttcttatatttctagtatttaagcgtcacctgccacccctttacctgagctacaagtcacgcattgcattagactcctctgctttcttctttcacctctaactagactattaaccaaaaatttttnaatataactttcaaaaggtnttttattacatcatttccatcctttatgtttgggttcnagccctcattaactttaacatggattcttggagtaccctccttactgattttgttacacntgtccctcttttagtcagtactaccatgataataccatggataataattttttcatttttatttttagtcttgctctgtcgccnaggctagagtgcagtggcgcgatctcagctcactgcaacctccacctcccgggttcaagtgattctcctgcctcagcctactgagtagctgggattacaggcacctgccacagctcctggctaatttttgtntttttagtagagatggagtttcaccgtcttgaactcctgacctcatgatccaccctcctcggcctcccaaagtgctgggattacaggcatgggccactgcgcccggccaataatttttnttntntntgtgctaatcatactacattttctttagaataaaagatcacatacttgtttgccattcgcagtctggccccattgtgccattctagacttacctcctgccactccccaccagctttgttttgtcttagccacacaaaataatctagcgtctctaaccagtcaaacattttaccttgtgccttggctcactctgtgccttttctccagaatatctttctgtgtacttttctcccatccttttncctttaaacctgctgctatggtttgnatgttgtttggcccctccaaaactcangttgtagttcaattgccaatgtaatagtgttggnagatgntacttttaagaggtaattaggttgctaagatggattaacatctttctcttgacactgagactgggttctcctgggaatggttagttcccaagagagtgagttgttataaaacaatgctgcctcttctattttgcnctttttgtttgcacaaactcggtccccttctgtttctctangatgttttgatgcagcatgaggcagtcatgagaacccaccagatacagctgcctgatcctgaatttcccagccaacagaaccaagtgctaaataaaactctttttaataagtt

SEQ ID NO: 276105 - DNA, 506 bp, Homo sapiens
ctatttgtcaaaagcaacaccatgctcatttatgtaggcttggcaccacctgactcctcccactcctgagcctgcatttcaagttctgtaaatataaactctgtactagcatcattatatctctcttttccactcctgctgctcccctcttagttcatgcttcctctcatttgatcagctcatctttggcaagattttgcaataatatactaagctagctccctgcccccacatcctagcactccagagagttattcattctcatcacatcagtgatctttctgaaatcagaaattcaaccacgtcacttttcagcttaccattcaatgaatttcttcgaatgctaaacatagaattgccacacaaccaagcaattccactcctaggtatatatccaagagagatgaaaacatgtccacataaaaactggggggctgagcaccatggcatgcacctgtaatccaagctactcaggaggctgaggcaggaggatcacttgagcccag

SEQ ID NO: 276106 - DNA, 428 bp, Homo sapiens
accattggaaaaatcctgtagtccaaaaagttattaggatatatgtttttttctatatgtatacttaggtaaagaaacagtgtacagggctgagtgttctgggatttctctagaggctggcaagaaccagttgttttgtcttgcgggtctgtcagggttggaaagtccaagcagtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaacc

SEQ ID NO: 276107 - DNA, 803 bp, Homo sapiens
aaggaataaatcgtccctgccgaagaatttcaaataattttaaaatgtagaaggaatgagggaagtagaaaatcaacattagaacaacacagtaataattgctacaggctagcaattcatctgccaatgaatgctaaaattagtgggagaaacttagaggagaaacagaatacttgcacagtctcaaagtatctcctccaaaatatttattaattactgtggttattttaacacacgtccccaaattctttgatactcctccctctagaagaatagcttaattttcttcttgagcatggggctaaactttatgacttgcatctaacaaaaactttgaaagaaggaaaaacagtaactttacgacgaaaaaatatggcagacaccacttcaagtgatcaaggttaatatcatcagtaacaaatcatgttaatataatgcattatatgttgcaataaaaagggcactttaccttcggggtattcatcccaaaagcgcataaccccaggctaatcatgagataaacccaaactaagggtttatacaaaatacctgaccaatactcttccaaagtgtcatgctcactaaatagaaggaaagactgagaaactgtcatacactagagaaggctaataagacatgacagctaaatgcatcatggtatcccagactagatctgggacattaaagaacattagtgaaaacaagtgaaatccaaatatattctgtagtttaatgaatggtactgtcccaatattaatatctttgttttaataaatgttacatggctatgtatgatgctaaca

SEQ ID NO: 276108 - DNA, 460 bp, Homo sapiens
ggccattgctcaaagaatgcagcctcctggtcacccatgttgtccccttgccaacaaaaagagtgaaacactgtgcaatgtttgaagagatttattctgagccaaatctaagtgactgtggcccgtcacacggcctcagaagatcctgagaacttgtacccagagtggtcagcctgcaactgggttttacaaattttagggagacataagacatcaatgaatacttgcaggatggacattggtttggtccagaaaggtggggacaactggaagtgacagagggacttctaggtcataggcagattcaaagattttctgattggcaattgattgaaagagttaagttgaccgggcatggtgggccatttctataatccttgccatggggaggctgaggaccatttgagcccaggagttagataccagcttgggcaacatagagagacctcacttctccaaa

SEQ ID NO: 276109 - DNA, 438 bp, Homo sapiens
gccataagcgtctgcacagagccagtgaaagattccatgagatccacaaaacacttcatgaatgagaacagcctttagttcccaccgtgcccagagatcactgaactcagttcacgccagtgccagtcgaaaagaacattttggccatatgcggtggctcatacctgtaatcctagtactttgggaggctgagatgggaggatcgcttaaggccaggagtttcagaccagcctgagcattatagtgagatgtcatctccaaaaatatattaaaaaaatttttttaaaaagctaggcatagtggcaagcacttgtagtcccagctactcagaaggctgaggcgggaggatggcttgagcccaggaattcaaggcttcagtgagccaagatcgcaccgatgctctccagcctgggtgacaagcaagaccctgtcccttaa

SEQ ID NO: 276110 - DNA, 409 bp, Homo sapiens
tcttgggagggtgtatgtgtccaggaatttatccatttcttctagattttctagtttatttgcatagaggtgtttatagtattctctgatggtagtttgtatttccgtgggatcggagccatcaccaagatttaatagatgacatgtcctgcaaggtgggtccctggctacttctctgacctcagctcctaccactgctcctcctgctcacatactgttttccaggcatgtttactcacttgccttagcagacatttgttgagtcatgtgctgatgtggacactggggatacagccgtgaacaagcagaggaagatcctgccaccaagcagttaccttctagcacaggaacagtagacctagcacatgataaattgtgtattatggcagaagtggaaggtgctatagaa

SEQ ID NO: 276111 - DNA, 434 bp, Homo sapiens
  misc_feature (20)..(20): n is a, c, g, or t
  misc_feature (22)..(23): n is a, c, g, or t
  misc_feature (26)..(26): n is a, c, g, or t
gagacaaagtctccctctgntnncancccaggctggagtgcagtggcgtgatcttggctcactgcaacctctgcctcccaggttcaagcaattcttgtgcctcagcctcccgagtagctgggactagaggcatgcgccaccatgcctggctaatttttgtatttttagtagagacggggtttcgccaggctaggctggtctcgaactcctgacctcaggtgatccacccgcctcggcctcccaaagtgctgggattacaggtgtgagccaccgcacccggctgaaattttctactctgtgattctttatggcaaattttcaatttcagggcagcttctccttttctacctaacacacttctactacttttaccccactgtcctgtggctggtatctcaaaagagttttatattgacccaatgagggagagccta

SEQ ID NO: 276112 - DNA, 408 bp, Homo sapiens
tgggaagcaagcaatgacaagaaagtgctaaaccagagaaggaaagaaggtaaagaatagcacgtgcactgtgagagaattgtgctcatgattggactcattaggtttcaatgggtttgtttcgaaaccataagaaccaaaggcctgtgcctactttagacccaccaaaatgaagcctttaaaaaggcttaataagattaacaagacagacataatttgaaagctgagttccactaagttagagggacttgggaaagaccttggccttttcacaaattcagtttcacaaggtcataaaaccaagtctttgcaagtacaaggtgatccattttaagtaaaatttctgctaatattgaatcagagtttttacattgtataatccaaatatccaaggttttcaataaagaa

SEQ ID NO: 276113 - DNA, 503 bp, Homo sapiens
aactttctactggagagattaggcgtgtgacacctggatccaattaaccacctctgcagaaagccaagaaaagaaatagggttatccaggaaagatctgtggaaaatgctcatgtctaatggcatgggatcttttgacatacatgaaagatgcacatggaatattagaatgttataccactacatacactgccagcttggactgaagggaacagagatggcatgaaatgaagaaaggctgtgcaacctctgaaatactgcatgaggaaaacagaccgataaagctacttggctgcaaacatctctcatctttcaagaaaagggatgaatgactctgagtgtggtttagaggtcagcggatcttattcccttctgcttaaggggatggataccccattctccgtgatgtgtctatttcatataacatgcctatatcaaaacttgtcatgtaccccataaatatatgcacctactatgtaccctcaaaaattgttttaaattaat

SEQ ID NO: 276114 - DNA, 404 bp, Homo sapiens
aactaaaataacaatatctgctttagataaattggcaaacgtttaggattgcaaatattcagtgggggtgtttggctttttcagtaacacgtattattgctggtgcattcttgagggatggaggaggtggaagaaataattagctgcacattttctataaattagttcatatatgtcagttaaataggaacagtatgtggatttaaggtttagttgtgtggccgtaatcacatccaacaccaagtcggccaaccatatgtgagcttaatcccacagaattcttatgttagacctccctcttcagataatagaggagattttttttaagtatacgtgcacagaggaagtgacttctttctgcgcactctgttgtcactggaattaaaattaaattacaatctaaa

SEQ ID NO: 276115 - DNA, 1023 bp, Homo sapiens
ctgacataacttttctgcatttcttgcaagctaacagctgaaccaacaaaacccaagccctaattttaaaaaagatagttggccaggctcaatggctcacacctgtaatcccaacactttgggaggctgagatgggaggaccgcttgagcccaggagttggagaccagcttgggcaacatagtaagattctgcctctacaaaaaataaaaaataaataaataaattagccaggcatggtggtgtttgcctgtgattgcagctactcaggaggttgaggtgggaggatcgcttgagcctgggaagttaaggctgcagtgaactatgatcatgccacttgcacttcagcctgagtggcaaggcaagacccagtctcaaaaaaaaaaaaaaaaaaaaattgaagcttaataaacagaaacacaatacagctaaagagtaatcaacttgctccaaacttaatacagctcccagttctcaaatgaatccaaactcctaatacatatcaaaccaccatcaagtatgcgtttttttcccattctaaacttttattctcattactcattgactcatatactctactccagtacataatgtccaaggatatgaatctagagtttactgtacatgtatatgtgtaagctgcattcttatcccttccctgaccactttgttgacatcatttgttgcaggatgaatagcagtttgctatgtcgaccaggagagagaggagaggagcagaatatattctaggcatatttttcccactatagatagaatgcccttcttttcattctgtgccttcagtctcgtctcttccctaaagcactgattaaaatttaacttcatgaagccttctgaaactgattccaaccaaatgcagaaatttcaacaaactccaatatattcattttagagttaacagttttcttatacattttagcttgtttagaagccttcccattttgtatgtctcaatattgtgagcaagtttgtatgctgataaaattcacattattattaaaaac

SEQ ID NO: 276116 - DNA, 400 bp, Homo sapiens
acggggtttcaccgtgttggccaggctggtctcaaactcctgaccccgtgatctgcccaccttttcctccattatgctgggattacaggagtgagccaccgagcccaacgtcatgcaagtttttaatatgtctatctccatgaattttttctttttcatgtatcttttgtgtcttacttaagaaatatttctctaaatccaagaaatggaggtattctcctatagtttcttctaagtgttttacagttattttcttcacatttagatgtttaacgacaaaagattctttgcttgtccaaacttcagtcaggtttctgagtcttctcctaagcccatccacgtactttcttgtaaaactcagttttggcaagagccctgctgggtcagttcagcaagaacg

SEQ ID NO: 276117 - DNA, 426 bp, Homo sapiens
taccaggaatttacaactcctgttttaattcaagcagcttgcattaggacataaaatctaggtatattttaaaagtgtagttttatgtgaaataactgaagaaaaattgtcctttcctaaaaagtattctttcttcctcggtcttagcttgcctgcctctccctcatacacatatcttggcactcaagaatcaaagttaccaaatccctcttttatgacattgcaattttttggcaaggacaagcttctttccaattctgccacattcatttatttgaagcttgtgggagtcttatggcaagcacattatttctgagaaggctttaaaaaaagaaaaaaaatgcttcatggctaaaccttcactatggcatttaggcaaagaaggtatcccttcctcttagtacaaccacgaatgatcacttacag

SEQ ID NO: 276118 - DNA, 342 bp, Homo sapiens
ggcacacgccaccacacttggccaatttttctatttttaatacagggtttcaccacgttggccaggctggtctcaaactcctgacctcaagtgatctgcctgcctgggccttccaaagtgctgggataacaggtgtgaaccgccacacctggccacaatttccttatgaattattccatcaccaatatctttcaggccagcagtgcttatatctgtgcatgcttagcgccatgaaaaatccattgctgaaggcggggattacaggtatgagcacacgccggcactatctcacttttgctatgatactgtatgtaggaaatatgggctctagtgtcttacctg

SEQ ID NO: 276119 - DNA, 216 bp, Homo sapiens
aggaggcaaaaagacataattagaagaccacccagagggtatggtacagtggaagccaggggaatgggcaactttcagagggagggagctatcaatggggtcaaatgcacagagagatctaggaaataatttaaaagcccactggatttagcaattcaggaactactggttcatcagtagtaaggtaggagcagaagccagatgctgggaattgta

SEQ ID NO: 276120 - DNA, 407 bp, Homo sapiens
cctgagaagcgtctgtgacccacagtaggtcatatggagaagagatcagcaaaaattcagcaaagagagagtgaaaggggcaatttcaataactgctgaagtgggtggtttgtctggatgacaacctttcagaaagcacttaagacagccactccctgggtgttggagtgggtgcctgcatgtccacattcagagaatctggccacatccgctcctcctcactccctctagcttaatcagaggcacctgattttgaattttggggcctctggttcccagcagcacagttaagggctacggattgtctggagagagactgggtcccggtgcaggcttttttttttttttttaaagacggagtattgctccatcgccaggctggagtgcagtggcgcaaagtcggctca

SEQ ID NO: 276121 - DNA, 705 bp, Homo sapiens
gaagaggatctggcagtgagtgctgtggaacctcagcatcccaggccagccaaggcagaggaacaagcagaggagacagaaagaatcacaagggaggaggaaactatcaggaagttcctttagagagcttacaattaactcactgaaatccctccacagctgcctgagataggttttgtcatacctccattttacagttggggaaactgagaccttgagtagttaagtagcatagctctaatgcaggaagtagtcattgacagacccaagatttgaagtgaggctgtcagcctcctgagttccccttcttaatcactactgctttccaagtttctagagtgtttcagtcaaaaacaaatgtgacagttaggtttgtgtaactttactatagtagatgtgtagttctcaatacatactttatcttagctagaaggctaaggaaacgatcaatatgtgttttaaatattgaaaaagagcttatggactttgattattgggtttgtagatgcatagagatctcatgacctggctttgggaatctggtccgatcttgtcattttgcctttggcgaaagtgaaggcccttgttgagggacctacccgacacttcactggagcttgagcctgggtctcttgagtccaaggacagagtttttcccattgtactatgatgtccttggaatgtgtgttcttcacacagacagtg

SEQ ID NO: 276122 - DNA, 951 bp, Homo sapiens
taaatgatgtaatggtctataaggtagtaatctggcacagcttcagtaatgtgtgctgtgtttgtaaaaaggtgaagtactttattggcattttctaagccctctgacattgttagtgtctgggttggttggtttgcattttactattatggtggaatctgtgttccttcaccattggttaagtctgaggaactaacagtgaaattcattgatggccaacttggataaaaatgaagaatgatattttcccagtttactacacatggaccaatagtgattatttgggagagaacactgggtagtattgtttgacttaagaaccttaaatatattgaaaagtaatggcattcttgctcatgatttgcatttgttagtgaggtctcaccatagtattttaatgtagcttcttattaaaattttattcataaatagtttagcagtcacagaggtgaaaaaaaaaagatttgcaccatcatatccgagtctttactaataaaatgaggctgcttaagtacccaagtggagcaagggaagagttactacagttactgtaagtctgagttagaaaaaatacagagcatctagttattgagcaaagcccccttttacctgttcgcttattcaaagagaaacaatagaatttgcttctcagtacatgtttttaaaattgagaatctctgatgtgacaaaatcaatttttacaaaagttgaattaaaaacttttaaaaattgcttgtctttgggggtatgtctacatattcgtttaaatttagaaattcccacatgtttaagatatatgcccatcccctttttagagtaatcaaaatttctatcacagttcacatactggaatacatagtaaaattgagatgtgtccaagagattttcaatgttaattagctcattctaaatagccaatataaggtaacttctgtttaaaaaaaaaaaaaa

SEQ ID NO: 276123 - DNA, 1007 bp, Homo sapiens
taaatgatgtaatggtctataaggtagtaatctggcacagcttcagtaatgtgtgctgtgtttgtaaaaaggtgaagtactttattggcattttctaagccctctgacattgttagtgtctgggttggttggtttgcattttactattatggtggaatctgtgttccttcaccattggttaagtctgaggaactaacagtgaaattcattgatggccaacttggataaaaatgaagaatgatattttcccagtttactacacatggaccaatagtgattatttgggagagaacactgggtagtattgtttgacttaagaaccttaaatatattgaaaagtaatggcattcttgctcatgatttgcatttgttagtgaggtctcaccatagtattttaatgtagcttcttattaaaattttattcataaatagtttagcagtcacagaggtgaaaaaaaaaagatttgcaccatcatatccgagtctttactaataaaatgaggctgcttaagtacccaagtggagcaagggaagagttactacagttactgtaagtctgagttagaaaaaatacagagcatctagttattgagcaaagcccccttttacctgttcgcttattcaaagagaaacaatagaatttgcttctcagtacatgtttttaaaattgagaatctctgatgtgacaaaatcaatttttacaaaagttgaattaaaaacttttaaaaattgcttgtctttgggggtatgtctacatattcgtttaaatttagaaattcccacatgtttaagatatatgcccatcccctttttagagtaatcaaaatttctatcacagttcacatactggaatacatagtaaaattgagatgtgtccaagagattttcaatgttaattagctcattctaaatagccaatataaggtaacttctgtttaaaaaaaaaaaaaagtcgaccggccgcgaatttagtagtagtagtagtagtagtagtagtagtagtaggc

SEQ ID NO: 276124 - DNA, 413 bp, Homo sapiens
ttcatttcactcagcctcagttttcttgtttgtaaaatgagataataattacacataccccaggaggctttcttttaatgatgaaattggaaaatgtatgttttactgcactgaatagcaacatgttcagtaactgtagctgttgctgttattatcatcattattattatttccaccaccattaatgttgccatttaaaattcttactgaatcacaggaggcctttaacttagctaacagtgatttgacaaatagaggtctttttcctaaggttttagttttttccagataaaagtgagctaattgtgggccaaattcagcctgtcctcttttttataaataaagttttgctggattgcatagccttatccatttgtttatgtattagctatggctgctttcatgctacaaca

SEQ ID NO: 276125 - DNA, 802 bp, Homo sapiens
ccttgctgaacgactctcttaacctccaccgctacagcggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtcaaaccaaaa

SEQ ID NO: 276126 - DNA, 434 bp, Homo sapiens
taagccatcgttgttttctttcactttggggaaagaaagaaacaaggaaatggatactctctagaagaggaggaagggtgttctctgcctgtttgcacattcaagttcaaagtggaggaaatcacatgacgatgggtgtcctgaggaaaatcttcgtgaaagatcttgacatgtgtcccctatacaaactccagaagacagaatgcggcagccacacgaaagaggaaaccaagactgcctgcttggtaagaacatcatggagtagaagctaagtgttgagagtaagccttggtcacatccaggggagcctcaggactccccttccctagatggggagctctgtgagggcagggcttgggatgagtggctgtctctggagtgaatagcacttggcagacagtatgcgctcaataaaaatctgctgaatgaactaa

SEQ ID NO: 276127 - DNA, 164 bp, Homo sapiens
ctttgagaactgctgatgaatatgaaaggtggcagacactgccaatgtgtaccgttatgtgttcaatagatgagagtttttatttgtagtctaacataattttgggattcaaaaatgccactgagcatcttttagggtgaagaagacacactaggcaaaagaaa

SEQ ID NO: 276128 - DNA, 1780 bp, Homo sapiens
aaggcctggtacggcccggagttatgtgtgtcaggccagcctgagttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctactcttccaccagttgtggcgtccagaaagcttccgttttctacggtcctgaccccaaggagggcttggtcagcagcatggagttcccgtgggtggtgtcgctgcaggactcccagtacacacacctggctttcggctgcatcctgagcgagttctgggtcctcagcatcgcatccgccattcagaacaggaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcagaaatcacatgacgatgggtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtcaaaccaaaa

SEQ ID NO: 276129 - DNA, 1434 bp, Homo sapiens
ttctattgagtgtttgctgtgtgccaggcactgtgctgtgctcagcacgtgttacaggcattaactgtgttcccaccttggctcagagaggatttggtcacttgccagggtcccatatctagctaatgatgccaagcttctactccgtcactttaagttagataaagtgtatgtggcagaattcccaagtcccagaggactgctccattgggagtagggaagacccagagcacggccagccaggctggtaagcagttgccaggtggcaggaagtggcttacactaagggttgaagcaaggcagagaagggaaaatgtgagcatttcaggacaaaacagaaacaaacaccaacatttcaggaatgagaagccagaagagagggaaggtttggccaaaggactggaaaggggcaagaaaatgaaatatgaaccaggaagctataggcaatcagcagaagtccacagctaatttgcataataaaaggaaaagtcatcttgttggaatttgtggtggtggctgcctagatttgaaattgtatcctataatttgccccatttccagtgagaaccagcgtaaaacatttctagaacaaacagtatattgcacaaggatagatttacaacaaaaactagtttttctaagacttgaagccttctgtcttttatcacagggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtcaaaccaaaa

SEQ ID NO: 276130 - DNA, 851 bp, Homo sapiens
aacattcttcccaaggcagtagaagaaatccttctgttgaactctactgtgtcaggccagcctgagttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctactcttccaccagaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcagaaatcacatgacgatgggtgtcctgaggaaaatcttcgtgaaagatcttgacatgtgtcccctatacaaactccagaagacagaatggtaacagttaccattctgtgttggagcggccg

SEQ ID NO: 276131 - DNA, 481 bp, Homo sapiens
agtctaacataattttgggattcaaaaatgccactgagcatcttttagggtgaagaagacacactaggcaaaagaaagaaaaggggttgcggatagcgttagtgatgatcgagacagacagcccacaggagagagggtcctgaggtctccttgccccggcagtgaggccccgcacctgctccgcaggttgtggcgtccagaaagcttccgttttctacggtcctgaccccaaggagggcttggtcagcagcatggagttcccgtgggtggtgtcgctgcaggactcccagtacacacacctggctttcggctgcatcctgagcgagttctgggtcctcagcatcgcatccgccattcagaacaggccagtgcccctgcctttggggcccgcaacatcgccgggggtgagggtgggggcgaccctgtttcctgctcagcctggggaggccctgaaaggtgcattctggggggacagggcttt

SEQ ID NO: 276132 - DNA, 1801 bp, Homo sapiens
aacattcttcccaaggcagtagaagaaatccttctgttgaactctactgtgtcaggccagcctgagttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctactcttccaccagttgtggcgtccagaaagcttccgttttctacggtcctgaccccaaggagggcttggtcagcagcatggagttcccgtgggtggtgtcgctgcaggactcccagtacacacacctggctttcggctgcatcctgagcgagttctgggtcctcagcatcgcatccgccattcagaacaggaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcagaaatcacatgacgatgggtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtcaaaccaaaa

SEQ ID NO: 276133 - DNA, 1623 bp, Homo sapiens
aacattcttcccaaggcagtagaagaaatccttctgttgaactctactgtgtcaggccagcctgagttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctactcttccaccagaaggacattgtcgttatagtgggtataagtaacatggatcctagcaagattgctcacacagagtatccagtcaataccatcatcatccatgaggactttgataacaactccatgagcaacaacatagccctcctgaagacagacacagcgatgcattttggcaacctggtccagtccatctgcttcctcggcagaatgctgcatacaccaccagtcttgcagaactgctgggtgtcaggatggaatcccacatctgcagaaatcacatgacgatgggtgtcctgaggaaaatcttcgtgaaagatcttgacatgtgtcccctatacaaactccagaagacagaatgcggcagccacacgaaagaggaaaccaagactgcctgcttgggggacccaggaagcccaatgatgtgccagctacagcagttcgatctgtgggttctgagaggagtcctgaacttcggtggtgagacgtgccctggcctgtttctgtacaccaaggtggaagactacagcaaatggatcacatccaaggctgagagggccggccctcccctgtcctcactccaccactgggaaaagttgatttctttctcccaccatggaccaaatgccaccatgacacagaagacatattctgattctgaactgggccatgttggatcatacttgcagggacaaagaaggaccatcacgcattcacgactaggaaacagctctagagatagtctagatgttagggagaaggatgtaaaggaatcaggcaggtctcctgaggcgtctgtacaacccttatactatgactattacggtggggaggtgggggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtcaaaccaaaa

SEQ ID NO: 276134 - DNA, 976 bp, Homo sapiens
aacattcttcccaaggcagtagaagaaatccttctgttgaactctactgtgtcaggccagcctgagttcatttctccttgagcaggaacagttcatggacgaactctgaggaccattctgaggacaagaggcatccagtgtcatgagtggaacatgcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccaagcactagggataagacagctgcccatggtgtccgcggcgggtctctctggggatggcaagatgcgaggggtgctcctggtgctgctcggccttctctactcttccaccagttgtggcgtccagaaagcttccgttttctacggtcctgaccccaaggagggcttggtcagcagcatggagttcccgtgggtggtgtcgctgcaggactcccagtacacacacctggctttcggctgcatcctgagcgagttctgggtcctcagcatcgcatccgccattcagaacaggaaggtaggatttttgcaggtcagaacaggttgtatcagcccgaagaaatcatcttggtttccttcgtgcttgttttcttttgcagcagtatctagtccaggagctaccccaccaaactgaagagtaaactgagaatgctgagtgccaggcattcaccatgctgttttgatgtctgtttttgatagttgcacactggggctgccacggataagcccatggcatacactgggctggctctccctcctctatccctctcccaggtgtgggaaggtcactttcactatgcttgtgaactaaatgctggctaacaagtgtcaaaccaaaa

SEQ ID NO: 276135 - DNA, 385 bp, Homo sapiens
gatttgggggcaataatactgtctgccacatgctgtcatgaatgctatctagttttagtctcttgataactctgtgaggtaggtattattatcctcattttacagagtggaaaattgaggtttggtgtggctaaccaacttgcccaagatgtagccagtaataagcacagctgcctgaatcgaagccagtaccaatggtatatagccagccttgggcttcttgaggactcattttcatatagatgttgtcattcagtaaacattgataaagcatctactatgtgcctggcgctgtgctgggcattggaaacacagtgatgtgcaagacagacactcttcctactctcatggagtttagagtccaaaggaagagagaggcagacag

SEQ ID NO: 276136 - DNA, 395 bp, Homo sapiens
gttttatgaaacttgcctgaaatcacttactttaaaaatgacataaagttctacctcttgggagcttggtaaaaataaaatttctcaaagaaaaattcaatgggcactacatctccagtacctaacagtacttggctcataaaaggctctcaataagcatttgttgaatgaatactactgaagaatctggctaatgctgcacatataagcagcaccactggaaatatagaacaggttctgaaggcaaagtctgagcaattacttgcaaagtcacacctgtggcaacagcctttgtttgctgctgatatgttggggccatttgcacatcaagctggacaccatcctacttctcagaagtcatcatctataattacatccttcctgagagtctaaaa

SEQ ID NO: 276137 - DNA, 186 bp, Homo sapiens
tggaattacaggcatgagccactgtgcccagtctctcatacatttattttaagggttgtgtactattccgttccgtgaatatatcatgatttatttatacatgctactattttgcagctataaatatttctgcaattctgtaatgaatgccttatgattattccctcattacctcagtatttgggc

SEQ ID NO: 276138 - DNA, 252 bp, Homo sapiens
tctagaggactccccgcaaggtgaatgatgagacatttgaattttttgttcccatggaagaagtaaagaagaggtcactagatgttgcagtgaaaaatagtaggccacttggctcacacagaagaaaggagttaggaaaagtactgattgacttatcaaaagaagatctgattaagggcttttcacaatggtatgagctgactccaaatggacagcccagaagctgatgatgagaattcttatcactcacct

SEQ ID NO: 276139 - DNA, 596 bp, Homo sapiens
cctacccataaattgcaagaaccaattgcaaaatagatataaaggtgtgtgtctgtatgtgtttgtgcttctgggcacaatttttcatgacaatattgaaaatgaaagggtaaataaaaatatcagtctaagcaacttatttgacaacatggacataaacaccaaatgaaaaagctaagaaattaaaatggttgtttctagaaagagacttggaagtgcagaggctgaggcagagcagagcatttaaatatctatacaaaaattcaaataataaaaacatttagttaaagttgggaatcaaaataaataaccaccaagtggaaataagcaaataaatgaaaaaatatccataaaagcaaaactatatagccattaaaaaagaaagaagtccatctagattattttgaattttaacaatgttccagatttattaatttaaaaagtggcaattcatgctatgcatattttagggactgaagcatcaacagtgaacaaaaaaaccagtctgtgtcttccagactttacatatgaatgagagaaagcataaagtatgtacacattaaaaaaattatatttcaaaaagtcatgaattctac

SEQ ID NO: 276140 - DNA, 445 bp, Homo sapiens
ctcccaaagtgctgggattacagtctgagccaccacgcctggcccatatgacaaatatttatgaagtgttttccacagagtagtatggaataactctgggtgtgtgcaagatgaactgagctcagtcacaatacttttttttcccctaatgttaagaattattggctgggcagggtgactcattcctttaatctcagcactttggaaggcagaggtgggaggatcaggtgagcccaggagtttgagaccagcctggatgacaaagtgagaccttgtctatacaaaaaattagctgggcatggtggtgtgacctgtggtcccacctacttgagaggctgagttgggaggatggcttgagccctgggaggttgaagctgcggtgaaccttgatagcgccactgcactccaacccaggcaacagagtgagaccctgtctcaaaaagaa

SEQ ID NO: 276141 - DNA, 443 bp, Homo sapiens
atagaatggataaataaatcaaggaatggataaataaatcaatggaatattgcacagcaataaaaaggatgaactatcgatacatacaaccacatggatgacttttatcaatataatgttgaatgaaaatcagggccgggcgcagtggctcatgcctgtaatctcagcattttgggaggctgtggtgggtggattacttgaggtcaggagttcgagaccagtgtggctaacatggtgaaaccccgtctctactaaagacacaaaaaaattagccgggcatggtggtgggtgcctgtaatgccagttacttgggatactgggaggctgaggcaggagaattgcttgaacccaggaggcagaggttgcagtgagccaagatcatgccattgcacgccagcctgggcaacaggagcaaaactccgtctcaaaaaaacaaaaaaaca

SEQ ID NO: 276142 - DNA, 238 bp, Homo sapiens
aagcatatttgaagggacacaggaatttctcagaacagaagggcaaacagcccagtcagggctcatgggaactgggaattagaaagctttctgcctcgccgagcttcataatctctgggcctccacttcctctcctcccctccctgggctggctgcctctgctcacccattttgcccttgtctcgtcatgccactggcccccaactccacgtcattgcctctcagcccaggggtcacc

SEQ ID NO: 276143 - DNA, 1296 bp, Homo sapiens
tgttgagttgatccttttatcattatataatgtatttctttgtcttttgtaacaatttttaacctgaagtctatattgtctgatattagtatagttactccagctctcttgtttactgtttgcatgaaatatctttccatcctttcactatcaacctatttctgtctttggatctaaggtgtgtctcagcatatatctcaatcatttcttttttaaatccattctcccaatctcctcctcttaattgcagagtttaatcaatttacatttaatgtaattgctgataaagaaggacttctgctattttctaggtcttatacaggcaaccctttcttttttgtcctgtgctttattgcacattgctgatattgcattttttttacaaactaaagattcatggcaaccctgtatcaagcaagtctatcagcatcatttttccaacagcatgtgctcacttcctgtctcttgtgtcacgttttggtaattctcacaatatttcaaactttttcatgattattatatctggtatagtgatttgtgatctttgctatttccagtattctgtttggctttcaacagtttgattataacatgtcttggtgtagatgtctttatcctactttggagtcacagaacttcttggatgtgtagacttatgtctttcattaaatttgattagtgtttgctcattattacttcaaatattctttctgcccctttctctctcattctgggactaccattttgtgtatattggtacacttaatggtgtttcacagatttcttaggctctgtttatttttctttattcttttttctgtttctcagattggataatctcaattgacctatattcaaattagctaattattctgcctgttcaaatctgttctgtcactgtacttttcagctccagaatttctatttgattccttttttataattttatctctttactgatactgtctacttaggacactgtttttcatggtttcctttagttctttgcccatagttcctttagctcttgaggatatgatttaaagtccccattaaaaatgtcaaatgtcttggcttcctttgggacagtttctatcagtttcttttttcctgtgtatgggtcattgtttcttgtttcttatgcctcatattttttgcattttgaatattataaggtggcaactatgaaaatcagattctctccccacccctgggtttgttgttgctgtctgttatagctgttatttgttcagtgacttttttgaactgattttataaagtctattttttgtcata

SEQ ID NO: 276144 - DNA, 1195 bp, Homo sapiens
aggcagttggtatgctccaggatctgagcagctccttctagcatccttcatccttcaggtaccagccatccagacagtgcttgagctgcagaaactgagaccagacctctggcctggccctccccaggggcctcctttcgtatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccacctttgtggccgaccccaagcaccccagagatatgaggcaccctttgctccacccacagcagggccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagcctcagaaaaaaaaaaaaaaagacaaaaaaagaaaagaaaaaaaaacaaaaaaaaacaagaaaaaagagggggaaacaatagaacaaacaaaaaaaagggcgggcgcacacacgaaaaaacaccgaggggacacacaaaaagcaaagcacaacacatgatggaaacaaagcgcggccccaaaaaggggagccagaaacgacagaagaagaagagggcgcaaaaaaacgaacgtcggggagaaacagacaaggcaccaacggaagacaaactactgtggggggaacaaacggagacaacacgc

SEQ ID NO: 276145 - DNA, 835 bp, Homo sapiens
aggcagttggtatgctccaggatctgagcagctccttctagcatccttcatccttcaggtaccagccatccagacagtgcttgagctgcagaaactgagaccagacctctggcctggccctccccaggggcctcctttcgtatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccaccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagcctcag

SEQ ID NO: 276146 - DNA, 432 bp, Homo sapiens
atgagtattgggcaagcacgcaagatggtggaacagcttaagattgaagccagcttgtgtcggataaaggtaggtgggaccctggctggctcccattagttggccaggctgtgctgtgctgcaggttcccaaagctcaagataagagatgcgttctttccttcactccctgaggtcaggggaggagtctggggctctgtagagagagctgtccccaggcctctgggggggatgagggagaagacaagtcgtaaggagccctggagatggcaaaagagaacccatttggggagggaggctgcagtccccttcagaggtcctggctaacaatacccttcctggctgtgtcccaggtgtccaaggcagcagcagacctgatgacttactgtgatgcccacgcctgtgaggatcccctcatcacccctgtgcccac

SEQ ID NO: 276147 - DNA, 899 bp, Homo sapiens
aggcagttggtatgctccaggatctgagcagctccttctagcatccttcatccttcaggtaccagccatccagacagtgcttgagctgcagaaactgagaccagacctctggcctggccctccccaggggcctcctttcgtatagtcactgcttctgcatcagatactttcagctgcaactccctactgggtggggcacccatttcaggcagaaggttttggtaccctccactgaccctacacccagggctgctactgccgcttgtggcttcaggatgaaaggtgagaccccggtgaacagcactatgagtattgggcaagcacgcaagatggtggaacagcttaagattgaagccagcttgtgtcggataaaggtgtccaaggcagcagcagacctgatgacttactgtgatgcccacgcctgtgaggatcccctcatcacccctgtgcccacttcggagaaccccttccgggagaagaagttcttctgtgctctcctctgagctcccctgtcccttctcacaactcctcccttttccctctcctgggcccttccttaggtcagtaattgttgtgagccccttaggctccttgcatcccatccctaacccttgcctgaccatgtgaggttatctgaagcacaaggcccaccctcacctatctgtcgaccccatttcctaccacctttgtggccgaccccaagcaccccagagatatgaggcaccctttgctccacccacagcagggccccgtcagactctgccagcgcgtcctgcccgcttccctcggtgacctgctcagacaatggagagggatgggccaggttcttgctctcagtctcacctggagctactgggagggtaaagccatttgaagaataaagtcatccagagcctcag

SEQ ID NO: 276148 - DNA, 1065 bp, Homo sapiens
tttttttaacacttggaagctcctcaggagcagaaacaacgtgtggttacctttttgtattcctgatggtgctcagcatagaatgcatcacatgacatgtgtcaatatttatttgatgaatgatctgacatgacatggaataatccaggaatgccaaggcatggattcaccacttctgaaaaaacctgggaaactgctacaaaaggggttgttctgatgatccactggcaaagaggaggcacaaaaacagccaggctccagaattcactgaggtgaaatgagttaatgaaaatcaaaacagaggagcagcaagaccagtggaaataactccaatatccaaggagtgaccaactggcacagatcatcccccgctctactctccctccaaaagccagaccactgggaagtgtccacggcggtcagatgccatcaggagctgaaatgaaatggactatgcggtgtatgtcttcctttgtgtggggagaagggacttgtccataatgcgagtctgctggcccaggtcatgaatgacaggcacagctcccagccccaaatcatcacaagggtccatgacctattttcaacatttcaacaagcccaatccagcctgggcagcatggtgaaaccccgtctctacaaaaaatacaaaaattagctaggcatggtgatgcacgcctgtagccccagctactcaggaggctgagtggaagcaatttatagggtgcaagcggcagcactgtaagaaagtttgtgaggaaggagagttttgtaaccggagtcaaatccagaggggcttcctggcagagaaacaaaccacaggtcaggccaatgatggtcccagctctagcggggccctgccctgggcaatgcacattttagtaagaggtaagccaaggcctctgggcccccaacccttcactagtgctagtgtgctgaacccctggctcaggaagaagggaggtgctacaggggcaggccttggcatggaaggaattgggagctgctcggtataatgcaaacctttaactgctcttttgcctcttccattttactgttcctagagtc

SEQ ID NO: 276149 - DNA, 589 bp, Homo sapiens
aaagcaaaagcacttttaaaatgagttaagtggaagacgaacagacaaatgaggtaacttctataaagatggaggttgcttctggctcatcagccatcgttgatggtaaccagtcctacaattctcattaggcagttctgttaccccactatttccttggggtctgttgtgctaaggacaggattggttgggtaaaggggtgtggcacaaataaccctcaggaatacaggccacagagctaatgaagggccccaaggaaagaaagacctgcccatcagcgatgaattctctcccccagtgccacagacctgagggcacgtgacccaggaatgtgcatccaaagataatactaccttcagagaactctacttataggctgtggtttttcaagaaaaaggaaaagattcataattcattgagctctttccttgtgagaagaaaggccactcttttgtgtgctgaagttggacaacagttcccaaggaagctgaattctagctgaatattgttattgggttttgcactatgccctttatgttgtcattaatcaataaatacgtgtggaacaaatgattaactagaaaaaaaa

SEQ ID NO: 276150 - DNA, 573 bp, Homo sapiens
aaagcaaaagcacttttaaaatgagttaagtggaagacgaacagacaaatgaggtaacttctataaagatggaggttgcttctggctcatcagccatcgttgatgtgccacagacctgagggcacgtgacccaggaatgtgcatccaaagataatactaccttcagagaactctacttatagtggtgaaattgaatcactgaagcagctgaggcagagagcttttccttcaggattcacggcctatttctcagttctgggaagacaactctaacaactcaacagagtgaagagagataaagatgttgggaatgactgatttcaaacaatcaaaactgctttggggatgaggatgaagttgggacattactgccttgtataccacatactataatatttattatgtctattgtttattgtgtgtgtccttctttagaattttaactccccaagggcaaagatccctgactgttttgcttatcaatgtatccaaaaggcctaaaacagagccttgtaccctatacacactctgcaaatatttgctgaattgaataaaaggctgccgatctaaaaa

SEQ ID NO: 276151 - DNA, 396 bp, Homo sapiens
aaagcaaaagcacttttaaaatgagttaagtggaagacgaacagacaaatgaggtaacttctataaagatggaggttgcttctggctcatcagccatcgttgatgtgccacagacctgagggcacgtgacccaggaatgtgcatccaaagataatactaccttcagagaactctacttataggctgtggtttttcaagaaaaaggaaaagattcataattcattgagctctttccttgtgagaagaaaggccactcttttgtgtgctgaagttggacaacagttcccaaggaagctgaattctagctgaatattgttattgggttttgcactatgccctttatgttgtcattaatcaataaatacgtgtggaacaaatgattaactagaaaaaaaa

SEQ ID NO: 276152 - DNA, 1032 bp, Homo sapiens
  misc_feature (688)..(688): n is a, c, g, or t
  misc_feature (777)..(777): n is a, c, g, or t
  misc_feature (885)..(885): n is a, c, g, or t
  misc_feature (934)..(934): n is a, c, g, or t
  misc_feature (948)..(949): n is a, c, g, or t
  misc_feature (960)..(960): n is a, c, g, or t
  misc_feature (972)..(972): n is a, c, g, or t
  misc_feature (976)..(976): n is a, c, g, or t
  misc_feature (1005)..(1005): n is a, c, g, or t
  misc_feature (1015)..(1015): n is a, c, g, or t
  misc_feature (1018)..(1018): n is a, c, g, or t
  misc_feature (1021)..(1022): n is a, c, g, or t
aagttgaggaggagtgtgagtggggctactgtggtgggatctccagggcagccccatccagcattttcattcagggtcccggagcgggtgtgggcagtggtttcgtggtctgctgccagccagggcaggggagcccttatgaagctcctgaggtggaaccaggcatctgagcccaggcttgttgcttcttagagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacaccccccaaagaagacggtcaacttgtctggagtatactccagacaagttgaccgcccagaatatgaggctgacttgggcacactaggggaataccccaaaggcctgaaggaggtgccactggnctgccagcacttcaggaaggcacagggccccacacccccgagatccaagctgcactggctggcagggggcagggcggggggtggcgagnacacagtcccgtgtgtcccagcaccggtgccaccctccttagccccgggcaggcagtacgtacatgcggaccccgcctctcaaagcacgtttatggaaatgaacaggntggggtggcccgcgctcgccggtcacatgttggctcgttcccgctgcanccgcgagttgtagnngcgagacacgntgttccaggcgnccangtagcggtccatgcacatggcgatgcacntcgctcgagntgnccnnggagccccct

SEQ ID NO: 276153 - DNA, 530 bp, Homo sapiens
aagttgaggaggagtgtgagtggggctactgtggtgggatctccagggcagccccatccagcattttcattcagggtcccggagcgggtgtgggcagtggtttcgtggtctgctgccagccagggcaggggagcccttatgaagctcctgaggtggaaccaggcatctgagcccaggcttgttgcttcttagagttgaccaggacagcgctttgcacaacgatctccagatcctcaaagagaaagaaggagccgacttcattctacttaacttttcctttaaagtaagacttttcttttccagtctctccctctggcctaggctgcccagtctgcctgacagtcctgtggaggatgctggcctccctcccctgattgtcgtctctctctctctcaggataactttccctttgacccaccatttgtcagggttgtgtctccagtcctctctggagggtatgttctgggcggaggggccatctgcatggaacttctcaccaaacaggtgagcctgtctctccccttggccag

SEQ ID NO: 276154 - DNA, 191 bp, Homo sapiens
tgacagcctgcagaaggtgaggggcagtaaggccacagctagccatggcctgatctggtggcttcctctccccagtctcaatacagtctgacaagagcacagcagtcctacaagtccttggtgcagatccacgaaaaaaacggtgaggctggagccaggactcaggagattcggacacttgccacacccag

SEQ ID NO: 276155 - DNA, 3086 bp, Homo sapiens
agcgtcctgcgcgggtagcccctgggagcacgcggcaccgagtcacgtgagaggggagcgcaggcgaaggggcgtcgcgcgcaagcacgcacgacatacgcaaactcgcactgaggcgcccacagagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276156 - DNA, 2943 bp, Homo sapiens
  misc_feature (154)..(154): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggcccttatcgagggtaccggctcgat

SEQ ID NO: 276157 - DNA, 3575 bp, Homo sapiens
  misc_feature (154)..(154): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggtgagtttgccccagagaggggcctgcacaagagtcacccataaagaagggtatggtggcaaggggcccaagaggttctggggtccaggagtgcttatgaacttttcaggccaagaatggagctcctcaagccagtggcttggttgcatgtccatctgtggtgaacctagagctgttgatctttttctctcagtctgggaaaggggtctgcattagagaccactcaccacctggaccattctactaacacctgttttttccctccttccaggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276158 - DNA, 3105 bp, Homo sapiens
  misc_feature (154)..(154): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276159 - DNA, 2018 bp, Homo sapiens
  misc_feature (20)..(20): n is a, c, g, or t
tcgagctcggtaccgcacgngttcggagttggagcaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276160 - DNA, 2213 bp, Homo sapiens
cacaacctcttccagaaacacaccaaaatgatcgtatcaccgataaacttggtgctacccccttcttgaccaccttttgaaaaagctcatctaactctcccatcatctcaggttgggcacatcattcccccttctcatctccaggtatgcaggctctcagcttcccatacacctctccccacacagcatagccctccccaatatcctcttatctctgccactggagacgtcttcagggattggggcaggacagggagggtgggcctgaaccttcacctcactgaccattccatttctttgcaggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276161 - DNA, 1878 bp, Homo sapiens
  misc_feature (154)..(154): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgcacccgcactgtgcagggcaaaatgggtccttggttatactatgtcagtttgttgttttt

SEQ ID NO: 276162 - DNA, 1661 bp, Homo sapiens
  misc_feature (154)..(154): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgatctataggagtggtggggtacgaatgaat

SEQ ID NO: 276163 - DNA, 1876 bp, Homo sapiens
  misc_feature (154)..(154): n is a, c, g, or t
  misc_feature (1839)..(1839): n is a, c, g, or t
  misc_feature (1851)..(1851): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctgttcggtttatactccggagtataaaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttggcaaggaaggaaatggcaccgtcatgggtgctgaatccggcatgttcntgtcacactggntgagaagatgacagaggccagagat

SEQ ID NO: 276164 - DNA, 1872 bp, Homo sapiens
  misc_feature (154)..(154): n is a, c, g, or t
  misc_feature (1528)..(1528): n is a, c, g, or t
  misc_feature (1617)..(1617): n is a, c, g, or t
  misc_feature (1725)..(1725): n is a, c, g, or t
  misc_feature (1774)..(1774): n is a, c, g, or t
  misc_feature (1788)..(1789): n is a, c, g, or t
  misc_feature (1800)..(1800): n is a, c, g, or t
  misc_feature (1812)..(1812): n is a, c, g, or t
  misc_feature (1816)..(1816): n is a, c, g, or t
  misc_feature (1845)..(1845): n is a, c, g, or t
  misc_feature (1855)..(1855): n is a, c, g, or t
  misc_feature (1858)..(1858): n is a, c, g, or t
  misc_feature (1861)..(1862): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacaccccccaaagaagacggtcaacttgtctggagtatactccagacaagttgaccgcccagaatatgaggctgacttgggcacactaggggaataccccaaaggcctgaaggaggtgccactggnctgccagcacttcaggaaggcacagggccccacacccccgagatccaagctgcactggctggcagggggcagggcggggggtggcgagnacacagtcccgtgtgtcccagcaccggtgccaccctccttagccccgggcaggcagtacgtacatgcggaccccgcctctcaaagcacgtttatggaaatgaacaggntggggtggcccgcgctcgccggtcacatgttggctcgttcccgctgcanccgcgagttgtagnngcgagacacgntgttccaggcgnccangtagcggtccatgcacatggcgatgcacntcgctcgagntgnccnnggagccccct

SEQ ID NO: 276165 - DNA, 561 bp, Homo sapiens
  misc_feature (12)..(12): n is a, c, g, or t
tagaggatcccnctcctcagcagacgcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276166 - DNA, 1276 bp, Homo sapiens
  misc_feature (154)..(154): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaaccgcttaagagagaatatatatactcaactgagtactgtctttcaaagcagtccctgtcagtttgtccattgattccatagcagctctcactgcccaccctgcttgagaagcctcttggagttgcctagagagtctatagcactcatctgaag

SEQ ID NO: 276167 - DNA, 3304 bp, Homo sapiens
  misc_feature (154)..(154): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276168 - DNA, 2873 bp, Homo sapiens
atgctgttctagaggatcccaacttcgacggacgcattcactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276169 - DNA, 2583 bp, Homo sapiens
ctgatccgcttaaggatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276170 - DNA, 2160 bp, Homo sapiens
attttgtcaggcacagctgactaacctttctcatgcaggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276171 - DNA, 2655 bp, Homo sapiens
  misc_feature (474)..(474): n is a, c, g, or t
gggtagcgcttcctgtggcgctgttcttctgagggggccccccgtgttgtctgaggagtcggtgcgaggacctgtgagtcttgcttgcgcacaccctggggccccggttcctgcacgggggactgtgtgactacacccctggggagggggaagcaggtgtggctcacgaccagtgtttgtggtgccgctatgtgggccttagtgttggcgagccgcaggggggttggacccgtgcgcactcgccaatagttcagggaatgggttggatcgccggatgagagtaaagatgagtccagaccagcatcgtccaaggaacaaaccgtaattgtgttcccgaagagacattggtgtcaaacacatccgtcatacactgtaacccaataaagcagtgtacatgaaataagagaaaataaattaaaaatccatagcatagctaaggaggctctagtctggagcacagctgagtttccagcnatataaggaggctcgaaagtttcttttataagaatgcctgctagcaagggttccagcaaggtggccttagcgtttagaatagccatcattgtcctgcaataggcagagctatcacgtccaggaaaaatgagggagggaaccacagaggcagcgtgagatccaaatacagcattcaaaggtaattggtccagtggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276172 - DNA, 2047 bp, Homo sapiens
  misc_feature (154)..(154): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgtgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaataaatagacacaataaaat

SEQ ID NO: 276173 - DNA, 1501 bp, Homo sapiens
  misc_feature (154)..(154): n is a, c, g, or t
ggggggggcctgtcccggaggtggcggcggcgccatcttggcgaaggggggatcaggaagtgcggaccgcggcggcggcggcggcggcggcggcggcggaccggagcgcaggccggaggtcccggcccgccggccccggagcggagggacgcgnaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaagtaaggatcctggtcctggggctggtggggctgggtggagccaagtacacttggggccactagcaggccaaggctgccttctttagaggaatgagcataaggcccccgggctggtggcattggatgagagggcctagggtgcccacaatggaacaactgtgccttggcccctag

SEQ ID NO: 276174 - DNA, 938 bp, Homo sapiens
aaactgtctatgggactattgggttggtttcaattaggaggattaaatgagatcataaagataaagtgtctatataggcaatatagggtccaataaatgttgggtattattattctgccattagctgaataattttgggaaacttaatttctctaaatttttattttctcctgtggagaaaaaagaattttaatgatatacatcttacacagtcctgtgagtcttcatgacagcatgtgtaaagcaccttctgtatgccagacacagagaaaacacatacaggttcccagaactctacagggtctgttctgttgagccgtgttgcctctctgatgaatgtttcaaaataaccatagacagaatatacacgatatatatgttgtgatcaaagaccgaatgagaatttttatgggagagtcataaatgtcttaaagacaactactaaatgcttttcttaagtcaatattttgaaggccaaaaaaaaatctactgaataaatataagaaataagaaggcttctgaaatcacaccacattttttaaacattcagtgactagtaccagaacctgatggataacttaggacgtttctgtcactaacagccagagaagatcgtcgggtggtcagagctggtcctggggtgcaggatgggcatatagcaggtctcagcctttgatgttccgcctgggtctgtccaggaaactagcaggaaaaactctaatcttggtagtattttagttcctgtgagccaccaacatacaatatttgtaatcagcatttcctacacagtctgatttcctctttgtccccatggtcttctcatttctatggctattaggaatctttccagacaggaaactgctattttcattaagatgctatcagagcacagattcaaaggaatgctacttaaggggagttttattccaaaataatga

SEQ ID NO: 276175 - DNA, 438 bp, Homo sapiens
gtccctgccagttctaatattctttaatacttctactgttgatctcagcacctatcatttaagtgcttcctggtatatagtctgtgtgtaactggagatacatggaggaagaacacatttggaagtagacacagtgagataggctgtgtgttccaggaagtggaacagattctcagtgttgtaggaattcagaggggagggagacctatgagtgctggagatggcacttgagctgaatcttagagaatgtgtgagcgaggccgggacactggttctcagctccagctggatgttagtattacctggggagtttttaaaaacatactgtggctgggccctgtggaccccatgccaggccaggtaaatcagaatcttggaggcaccacccttctcccctctctttcactcccttttcttctcccccatgggcatattttt

SEQ ID NO: 276176 - DNA, 401 bp, Homo sapiens
  misc_feature (44)..(44): n is a, c, g, or t
  misc_feature (52)..(52): n is a, c, g, or t
  misc_feature (59)..(60): n is a, c, g, or t
ttgtaacagacatccacatgattgttttcagaaatctagttttngagcctcnttcttcnnacagtaccatcattgctcagaatgtcttgggggcctcttgaatctgtactcaggtactgaagagcatctctggtggccaatcatcttttggagcttgtatttgtctttgggtgggagaaatgattaacatgtttttttagagacaagatgggattacaggtgagtgccaacttgcccggcctcctttcattctttaggcatgtttccttcagttctttgaatatacagttggttctcgctatttgcagatactgtatttgtgcattagcctacttgctaaaattatttgtaaaaccagctgactctgactgagcttttatgaaaaaatttcacctccaaag

SEQ ID NO: 276177 - DNA, 442 bp, Homo sapiens
  misc_feature (85)..(85): n is a, c, g, or t
  misc_feature (93)..(93): n is a, c, g, or t
  misc_feature (100)..(101): n is a, c, g, or t
gggacctttcttccccttgctggactcttctatcaaatctttcaggtactggatctccttggccaggaatccgccctctcttttngagcctcnttcttcnnacagtaccatcattgctcagaatgtcttgggggcctcttgaatctgtactcaggtactgaagagcatctctggtggccaatcatcttttggagcttgtatttgtctttgggtgggagaaatgattaacatgtttttttagagacaagatgggattacaggtgagtgccaacttgcccggcctcctttcattctttaggcatgtttccttcagttctttgaatatacagttggttctcgctatttgcagatactgtatttgtgcattagcctacttgctaaaattatttgtaaaaccagctgactctgactgagcttttatgaaaaaatttcacctccaaag

SEQ ID NO: 276178 - DNA, 291 bp, Homo sapiens
cacgccctgctaatttttgtattttgtagagatagggtttcgccacgttgtccaagctggtttcaaactgctgagctcaagtgagcctcccaaagtgctgggattacaggtgagtgccaacttgcccggcctcctttcattctttaggcatgtttccttcagttctttgaatatacagttggttctcgctatttgcagatactgtatttgtgcattagcctacttgctaaaattatttgtaaaaccagctgactctgactgagcttttatgaaaaaatttcacctccaaag

SEQ ID NO: 276179 - DNA, 552 bp, Homo sapiens
tagtaaatagtttgagagtaaagtaacaatatagatcccaaaattattagggtgttttgaaggtagaaccctgcatatatagctaacatttttcatttcttattctattctaattcattgatcgtgactcaaaaaatacagattcaaaactgtttactagtcagatatgtatgttcacaacagtctgacaaaaataaaattagtgttcgatatttagctgatatttaggatttgaaatatgcagttatcttctgtgaatacaaaattggcacttgctgcttgggtatgtggccttaattcggcagtgccagcacccacaaagctattgactgttgggatctttgtccgtaattagcattagctgccaccagtaagttacagcattttgataatggcttagtgactgaagagttagacatcttataggcataattatcttaaacagagattcaaacattttaaacatgcttttctaccccctaaaaaggcacatgacttatttaatacaaaattatttttaattgaagtcacaatgaaattttgtgaagcaaa

SEQ ID NO: 276180 - DNA, 777 bp, Homo sapiens
cttgtacttttcaattcctgtctgtccagcctgactggctactgccaagtctggtcactgaaagttttttatttgcagttgtgtaacattcagtcctttatcaatatatccttcatttcaaggaagctattatctgctaggcatcattaaaatatctgtatctcggtggggcattgtggctcacgcctgtaatcccagcactctgggaggccaaggcgggcggatcacgaggtcaggagattgaggccatcctggctaacacggtgaaatcccgtcactactaaaaatacaaaaaatttagctagatgtggtggcgggcacctgtagtcccagctactcaggaagctgaggcaggagaatggagtgaacccaggaggcagagcttgcagtgagctgagatcgcaccactgcactccagcctgggcaacagagcgagactccaaaaaaaaaaatctgtatctcttgcttaataacatatgtagcaagaactatatccttattacttagaagaagaaacaaaggttccaaaaagaataaataattaagttcacacagctagtaaatatatcagagctgtcttcatcacttagcggaatccacaatgattatttgtttctgtgacacctactatgaaattagatttaagaaacctttatgagcagaaaggctcctaaccctcacacctgtgtgatactctgctaattctgattatttttaatgtcctgctcccagtttgttttgagttgtgagctatgtgcagaaactcagtatggtcag

SEQ ID NO: 276181 - DNA, 1567 bp, Homo sapiens
ccagccgctgctttaagaggctgctccgcggtagcgagcggggccggagccgcagcccgaacgagcggaccgagccgaccgggcaggtgcacggctgcggggacggcagcggcatgaccggccaccacggctggggctacggccaggacgacggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgtggtgactgggggccccctggaagggccctaccgcctcaagcagtttcacttccactggggcaagaagcacgatgtgggttctgagcacacggtggacggcaagtccttccccagcgagctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaataccaattga

SEQ ID NO: 276182 - DNA, 1599 bp, Homo sapiens
agcggaggtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtggcccacaccagcctcctgggctgacgcggaagagagctccttcatcctgcctcagtttccttaggactcagagaaagggagaagaggcagaaggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaataccaattga

SEQ ID NO: 276183 - DNA, 1718 bp, Homo sapiens
agcggaggtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtggcccacaccagcctcctgggctgacgcggaagagagctccttcatcctgcctcagtttccttaggactcagagaaagggagaagaggcagaaggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccgtggtgactgggggccccctggaagggccctaccgcctcaagcagtttcacttccactggggcaagaagcacgatgtgggttctgagcacacggtggacggcaagtccttccccagcgagctgcatctggttcactggaatgccaagaagtacagcacttttggggaggcggcctcagcacctgatggcctggctgtggttggtgtttttttggagacaggagacgagcaccccagcatgaatcgtctgacagatgcgctctacatggtccggttcaagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaataccaattga

SEQ ID NO: 276184 - DNA, 792 bp, Homo sapiens
  misc_feature (3)..(3): n is a, c, g, or t
cgntagtattggtctttccgtatggtagctggctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccattgcgatactacatcgcaatggggtggagaggattccttcacttgtcccattaaccctcttctagtctagatgagatgaaatctattaatgtgtgtgtagaagaaaacgtatgttcttctactcagcattgccctcttccacctcctcacttcaccctccgagtagcttgtttaatcaagaactgtaatgaatgtctcttgtcctcaattatgcccatgcgatatacg

SEQ ID NO: 276185 - DNA, 216 bp, Homo sapiens
  misc_feature (3)..(3): n is a, c, g, or t
cgntagtattggtctttccgtatggtagctggctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaacctctgacctaccccggccta

SEQ ID NO: 276186 - DNA, 688 bp, Homo sapiens
  misc_feature (3)..(3): n is a, c, g, or t
cgntagtattggtctttccgtatggtagctggctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaacttgaagaaacaaaaacttattggcacgggagtaaattcagcattaaaataaatgtaattaacaaggaaaaaaaaaagtaaatccatagaaaatagagg

SEQ ID NO: 276187 - DNA, 740 bp, Homo sapiens
tccacgttttgcacacacagcgaacgtacaccaccaaacgtagacagttcagtagctaagaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccattgcgatactacatcgcaatggggtggagaggattccttcacttgtcccattaaccctcttctagtctagatgagatgaaatctattaatgtgtgtgtagaagaaaacgtatgttcttctactcagcattgccctcttccacctcctcacttcaccctccgagtagcttgtttaatcaagaactgtaatgaatgtctcttgtcctcaattatgcccatgcgatatacg

SEQ ID NO: 276188 - DNA, 995 bp, Homo sapiens
  misc_feature (39)..(39): n is a, c, g, or t
  misc_feature (52)..(52): n is a, c, g, or t
  misc_feature (59)..(59): n is a, c, g, or t
  misc_feature (75)..(75): n is a, c, g, or t
  misc_feature (83)..(83): n is a, c, g, or t
gccaggaggggccgctaggggcgagagttgagtttaggnccgccttgcgagntactacnaattttctggtgtaanaacatttnttggctttcatcttaaaaaatcagcagaagaaaaaagaaaaaaaaatagggcaaatgaaaaaggaagacaatgtccagatcaaagagttaaatatggacacaagaaatgcaagcagctgtaaagtgaaagatcaagaaccactctgagggctcagaagtagaaactagtgaactccaaaagcaaccctcaaagaaaaacaaaaaagcaagaaagattttaagtatccaacttacctgagtcaaaaaagggaagaagaaaagaagtagctctgaagatgtagaatgcctcgctcccagagcaaaagtaaagaaaatcactcagaaagacaacattaaaaaaagaagcctcagaagtttccaaagaaaacacagctatccctctcacacttaccagttcttgtggaacaaaaggatgctggtgatatccaatgagcggctgccttcgccctcacagggactccttccgactctcgattacgagagacattccttcggcgtacgaggtttttctgagagccctcctctaccccccctcttgccccaccctcttgttccttttcgaatcacgtggccgcccatttcgcatatacctgaccctggcacgcgcgtcccttttttccggcccagtgttctcctccctcctcttctgcgtgtttccgtgccccgcggatgctcccccccccctcctgtgtcccaggcctcgagtcggaggtggtcccgggtgcctgtgctccgctggttgcgggagagtggcgttcgttctgcttttttcccgttcttgagctacatctgtctgtttgagtccgcccctgcacgcccggtttcgttaccctcccttcttgggcctctccttctcttttacttttctcttgccactcccgtgttgtctaattcgctatttcgcacacaccg

SEQ ID NO: 276189 - DNA, 1162 bp, Homo sapiens
tcaggcatcaatgaaagtgtgcctttagcatcctctgaaacaaagggtaaatcagctgcaattaattattgtcatcagtgccagattcgaatttggaactctctctcagaggatttcagccaagaaaaactaagaaactatttctcccattgcccctacccctagacaagacttagcatagacaaaaaaacttccaaatctgaccaaaaacgaagatcatccaagtcttctggtgtaagaaacaattttatggctttcatcttaaaaaatcaagcagaagaaaaaagaaaaaaaaatagggcaaatgaaaaaggaagacaatgtccagatcaaagagttaaatatggacacaagaaatgcaagcagctgtaaagtgaaagatcaagaaccactctgagggctcagaagtagaaactagtgaactccaaaagcaaccctcaaagaaaaacaaaaaagcaagaaagattttaagtatccaacttacctgagtcaaaaaagggaagaagaaaagaagtagctctgaagatgtagaatgcctcgctcccagagcaaaagtaaagaaaatcactcagaaagacaacattaaaaaaagaagcctcagaagtttccaaagaaaacacagctatccctctcacacttaccagttcttgtggaacaaaaggatgctggtgatatccaatgagcggctgccttcgccctcacagggactccttccgactctcgattacgagagacattccttcggcgtacgaggtttttctgagagccctcctctaccccccctcttgccccaccctcttgttccttttcgaatcacgtggccgcccatttcgcatatacctgaccctggcacgcgcgtcccttttttccggcccagtgttctcctccctcctcttctgcgtgtttccgtgccccgcggatgctcccccccccctcctgtgtcccaggcctcgagtcggaggtggtcccgggtgcctgtgctccgctggttgcgggagagtggcgttcgttctgcttttttcccgttcttgagctacatctgtctgtttgagtccgcccctgcacgcccggtttcgttaccctcccttcttgggcctctccttctcttttacttttctcttgccactcccgtgttgtctaattcgctatttcgcacacaccg

SEQ ID NO: 276190 - DNA, 361 bp, Homo sapiens
atctgtgtaaactccctcactacccaagcaaaatgcctctgcccacactccaacatctataatgctttcaacttagagcatgattactgataaaatgccccatgattggaaagagtgtgggagtgaagatgatttcagggcaaatttgagcagagaaacttttcttttgggccataacagtcacagagatctaattgccttcccaccttaatgttttaaaaagagcaaaataaacctcagagagcaaatgataaagatcaaagtaggggtcaatgaaatagataacagaaatacatagagaaaatgactgatttgagaagattacaaaatattgatatatctctagtcgcgctaattagga

SEQ ID NO: 276191 - DNA, 485 bp, Homo sapiens
gtatctcttccaggttttggtatcaggatgatgcaggccttatagaatgagttagggaggagtccctcctttttaattttttggaatagtttctgtagaaatggcaccaactcatcatcgtccctgtggtagaattcagctgtgaatgtcttgtcctgggcttttttggttggtaggctactccttactgcctcaatttcagaactcattattggtctattgagggattcaatttcttcctggttcagtcttaagagggtgtatatatccaggaaggtttttattttcattcctctcaaagtattttctaatttctcttgtgacttcttctttggctcactggttttaaagaacgtgttgtttcatttccacatatttgttaattttccagttttcttcctatcaatttctagtttcattccattgtggtcaaaaatacagttattatttcaaccttttaaaatatattgagacttgttttatgg

SEQ ID NO: 276192 - DNA, 280 bp, Homo sapiens
aaaaatggcaacagtggacttacttgatacagggttgccacaaacctccaatctgtaaaaaatgcaacaaagaaccatgataaaatgagatatacctgtacacacatatgattatatgcatattattttacaatagaagaccttatacattattataggctaaagatgaatgaaaggatactcagacaaggaaagcttatagatacaaaactgagaaaggctaattgatagagatcttgaaaagaggagggattgagagagagatggaacacgtttctga

SEQ ID NO: 276193 - DNA, 417 bp, Homo sapiens
caagaaggcaaagtgtcagcttgtttgacctcggatgggaatgtgtgctctggacaactcacgttttttgctcctctgctaatgttcatgaacatgaaagcaccgtgaatacagattttgaggttacattttagtgagtaggcaaatttgcgtatatggagtccataaataaagaggatcaactctatttgcttttttaaaactgacaatatattaaggtaattaaaataaattcatacatagccattgtacaggcagaatataatacataagagtttaaaaatgtaatgttggatttgatcaaaggaagggggaaattatgggttggaaagaacaggaaggcttcatttttgcatctttgttgaaaactaggtttgaaaagaggtggggattctggaagcacatagagtcactgag

SEQ ID NO: 276194 - DNA, 313 bp, Homo sapiens
tttacctctagcattcctcatagtccttgctgacgagggcagctgtgatatagaaaaataacatccctttatggctatctttgccaaaatagcttctcactctgcaggcccagtctgatccaaacctcagaatctcctggactaacaacaactcaggccattgtgatttagaagtatctcagcactagagaagacaccaggatggccaggagacaatggcagcattagaaggccctagttgaacagaatatataatttcatttaacagctgctgaagctcattacgctggcatgaatgattctttacaaccac

SEQ ID NO: 276195 - DNA, 282 bp, Homo sapiens
tgtgagaactgtccaagggtgtggctggagcaggaataataaaaaccaggtgccactccaaccgctttgcataaatctagacatgtaatcctcacaacaaccccttgaggtagatacaattatgtccccctttttccagctggggcaactgaagcacaggtaatcttcctgacgttgtccagctagcagtgaaggagcagggatgaagcaaacccaggttccagggtccacattcctcctcaagcacttgcccacactgcctgtcaaaaaggaagggagaga

SEQ ID NO: 276196 - DNA, 335 bp, Homo sapiens
aaatacaaaaatcagccgggcatggtggcgcacacctgtaatcccagctactctggtggctgaggcatgaaaattgcttgaaccagggaggcggagattacagtgagctgagatcctgctactgcactccagcctgggtgatagagtgagagactgtctcaaaaccaaaccaaaacaaaacattgtatataaataaatgttatagcttgttatatggcttttaaaatgtaaatatgtatcaggtagtttgtagctataacaagaagtgatatctctaaaatatgcactgttaatttgtagtagaatccattaaatgtctaaatttctttttattt

SEQ ID NO: 276197 - DNA, 435 bp, Homo sapiens
aaacttggtgccaaatgaaatcattcaaattatagtcactcagttgtcattccaaatggtgtattttaaatttcgttgttgcttcatattttatatgtccccatatacaaattctattgctaagaagtggagctgacatttcatgttttttgtcacttacagagaaaactagctatttctgatctcttccactcaaataggcttagtttaagagaagaaacagaaccaacagccttactgtataatgatcctaagttattcatttagtgagtaattttttttattcagcaaactaagagttgggtttcagcaatgatatggataaaaaataatgttttatcacttcatacaaataataccataactgaacatgtattaataatatctagtaatgtatccagtaaaatattatcttagattgataacatcttaatc

SEQ ID NO: 276198 - DNA, 419 bp, Homo sapiens
actgatggcttacatcctgtctctgagtaaagaatcttatcgtgaggcactcaaattctattgcgagttcctcaaactatgtatttattaattgtcaggttactgattaatactgacattgaaagggacattgttttctttctaaatcataaagctctgctgatttgtttttactgattgtcttgtgcataaaacattttagcctgtacgctgtcatccataggcaatgattgtaacctctgtattgtaccctccaatggaaaaggataactccgatatgaggagtcccccttccttctcctaaacagtcttataaaagcattccaacttgtaacagatgttggaacatgcccaactttgttggtgtatcttactggataaattctcacatttggcttccaataaacttttatcaattt

SEQ ID NO: 276199 - DNA, 811 bp, Homo sapiens
tcccaggagtcagttacaacatgttcactagactgactatccccattgcccaagttgacacaagaggaaaccagcttccatcttacctcatctgaataaatctgccacaagcccatggaaaccccaattaacattgacagttaattgtgtacataaattacatttattacatttaattgtgtatatataggggatgttataggtttggaataagtggcccaacatttccaattatactgactttcactgggcttttttttaggctgttgcactttttctccacatgcttgcaatacaatactctcaaaataaaacgcagacaggtacctagtctccattttacctttagtactaatcctgtgtattagtctgttctcatgctgctaataaagacataacccaaactgggtaatttataaaagaaagaggtttcattgactcatagttcagcatggctagggaggcctcacaatcatggcagaaggtgagtgaggagcaaagtcatgtcttacgtggtggcacccaagagagcttgtgcaggggaactcccatttataaaaccatcagatctcgtgagacttattcactatcacactattgtgttgatattgtgttcacacaccaataatgatggtttatcactcactccatttccaaacccaccttcccacccacctctcaccaaacacacaaagacacactctttccctccactgattccaccagtatagccatatttctctttctggttaaatttatactaaatgtttacatttatataacttaataaatattatttttttccaaaaaa

SEQ ID NO: 276200 - DNA, 454 bp, Homo sapiens
  misc_feature (449)..(449): n is a, c, g, or t
tgaggacaaagtgagatctcatcactctacagagggagagttaagccccataataagccccgaatcctagcatttgctaaagtggaaatagtgtgggcaggtaggggaatagtcagttacgtattcgtctggcgctcggtaaatctgcacttcacacaggtcaggtgaatatggtccacgtttcatctgtcgctctctgcttgggaacaaaataaaaagcttcttgcatgacttagctttcagcttaatcctttccttttggcagagtaaatcttcctttcaccatactaaattaaattttggtattttcatacagtggaatattatatagctattaagtgatgtctttgggcaaattacttaacgtctctggcctttgacatctccttccataaaaggagaaactccagcctgggtgacagagcgagactccctctcaaaaaaaattntaact

SEQ ID NO: 276201 - DNA, 494 bp, Homo sapiens
tctcgcctgctctgcggcctccattcatgctgcacacagactggttctcctcctctaactactggccaaaaagggaagggagtacaagcatcaaagacaaatggttagtttaggaatcaaatgctaagactgaaatccaagtgagatatgaatctattctccaaagatgaacaaaggagtgtttataagatgggggaaaatccattcatttgatctagtgcctatattccaggtactagatgggctggatgctggggacggagatatgcaaggcaaagtcctgctctcaaataattcagaataatggaatagagaacactcaaggaaacagagattgcaaggaggttccctcgctataattataggttaaatttataacctatagaaaagattctttgggacttaggctcttcagcagattcttttctggtgattgctattatctcacccaacaggattaacaacctagacttaggccgggtatggtggctcat

SEQ ID NO: 276202 - DNA, 489 bp, Homo sapiens
ccctctcttctggaagcccctctgcagcactcctcttgggagtagaaaaggaagtggtcaagggaatggggtttcgccgtgttgtccaggctggtctcaaactcctgggctcaagcaatctgcccacctcagcctcccaaagtgctgagatgacaggcatgagccactgtccctggcccagacctacatttgggagctgatccgtcttgctctcagttagggcccagcccttctgtggggaccaggaaaatctttgctcacctggagaagctgctggttcagcccaactttatctaacgccaaagcctcatttaaggcactgagcttgacagctgcagcccgaagatcagctacttctgtcttcagggtgttttcagaactcgacagctctgcaattgactgctctgcctaaaaaacaaaaaggattaaagagtttcatatttccaattttcctggaacagtaaacagttcacattcccaacactgctg

SEQ ID NO: 276203 - DNA, 411 bp, Homo sapiens
tctcgcctgctctgcggcctccattcatgctgcacacagactggttctcctcctctaactactggccaaaaagggaagggagtacaagcatcaaagacaaatgacctacatttgggagctgatccgtcttgctctcagttagggcccagcccttctgtggggaccaggaaaatctttgctcacctggagaagctgctggttcagcccaactttatctaacgccaaagcctcatttaaggcactgagcttgacagctgcagcccgaagatcagctacttctgtcttcagggtgttttcagaactcgacagctctgcaattgactgctctgcctaaaaaacaaaaaggattaaagagtttcatatttccaattttcctggaacagtaaacagttcacattcccaacactgctg

SEQ ID NO: 276204 - DNA, 804 bp, Homo sapiens
gagtaaactcactagtagttcttcctatgaatatttctgtcctgggatccagagcaagattcttgccaaagtaaaaatcttatattattttcttaaaatacatagccttggttcaaatgtcatggcaattttttcaacttaacaaaactaatatttgccaggaaaactcatttaaaattcatccaaatattgtgaaaaaagtcgccattcgattgcaaactatttagacttttttttaaaaaacagaatacagagaatttgtaaaaatatttactgagaaaacacacaaaaaagactgacctactcgaaatgctagtggttttcctttatttgattgttcttgttctctgtggtaaagtaatactttctgaagaagcacctgggctaactcctttttcctgctgtgagttgattctacaagagttatggcctctgctaaacaggccctttgcccttggattaaaccagtataaagtttatccacaaatctttgctctttatcagaaagtccttctgtgtggtcctttaaggttgtttgtacacataattttctctttaagccatctgacagcagcatccactttgtacaatggagtccaagagaattaaacggctgagcacatgggattcctgatccgagatgagtacttgagtgaaagatgaagtggtaacatcggaaaggtgctcttaaaaggccttttaggaaatgctggtgaggatgtggtagcagcatgggcatattcgttttatttgtaactggagaaaacactggatgcgttttggctcaatgtgattgtgacctcc

SEQ ID NO: 276205 - DNA, 1264 bp, Homo sapiens
tcctcgatagtcgacaacgaaatgagaggaatgttaggtgggttcggcattacataaatcactcactctgtggacaagagccacgacaggcagcctctgctacatcttccttacggcctggcaaaagcaatctccctaaatgccctcggttggcttccgttccatttcccacagcagctattatgaacattcactgtcccataatctccccgcttgatgaggactacagcacctacttcacagaggaaataaaggcaagaacttcctaggcttctccctctcccgtactccacaggtgctaatgcagccaggaaacacaacaggagcaaagaggggcctggccttatgcatggaagctgaaggactgaaatttgcatttgatcatcttcaacttctggcacctgttgtcgcagttttctgagtgcccactgagctatccacaagctggcctcctctgaggagtacaacactcccaaactacttctctcagcttccacctaactctgcagaactcccttcctttagcgagaccaaacttagctagcagttagaggtcacccaactgtgccaattcctactaaattgtaacagaaagcccccagacctctgcaattgaaaaagaatcagccatacttaccaccactagtacaagaagaagggtccacagctagcacagataatttgtgccctctctcagtaagcatttttccaaaatattctataaatgttgattttccagcaccagggggcccagacaatcctactcgaaatgctagtggttttcctttatttgattgttcttgttctctgtggtaaagtaatactttctgaagaagcacctgggctaactcctttttcctgctgtgagttgattctacaagagttatggcctctgctaaacaggccctttgcccttggattaaaccagtataaagtttatccacaaatctttgctctttatcagaaagtccttctgtgtggtcctttaaggttgtttgtacacataattttctctttaagccatctgacagcagcatccactttgtacaatggagtccaagagaattaaacggctgagcacatgggattcctgatccgagatgagtacttgagtgaaagatgaagtggtaacatcggaaaggtgctcttaaaaggccttttaggaaatgctggtgaggatgtggtagcagcatgggcatattcgttttatttgtaactggagaaaacactggatgcgttttggctcaatgtgattgtgacctcc

SEQ ID NO: 276206 - DNA, 1223 bp, Homo sapiens
tcctcgatagtcgacaacgaaatgagaggaatgttaggtgggttcggcattacataaatcactcactctgtggacaagagccacgacaggcagcctctgctacatcttccttacggcctggcaaaagcaatctccctaaatgccctcggttggcttccgttccatttcccacagcagctattatgaacattcactgtcccataatctccccgcttgatgaggactacagcacctacttcacagaggaaataaaggtgctaatgcagccaggaaacacaacaggagcaaagaggggcctggccttatgcatggaagctgaaggactgaaatttgcatttgatcatcttcaacttctggcacctgttgtcgcagttttctgagtgcccactgagctatccacaagctggcctcctctgaggagtacaacactcccaaactacttctctcagcttccacctaactctgcagaactcccttcctttagcgagaccaaacttagctagcagttagaggtcacccaactgtgccaattcctactaaattgtaacagaaagcccccagacctctgcaattgaaaaagaatcagccatacttaccaccactagtacaagaagaagggtccacagctagcacagataatttgtgccctctctcagtaagcatttttccaaaatattctataaatgttgattttccagcaccagggggcccagacaatcctactcgaaatgctagtggttttcctttatttgattgttcttgttctctgtggtaaagtaatactttctgaagaagcacctgggctaactcctttttcctgctgtgagttgattctacaagagttatggcctctgctaaacaggccctttgcccttggattaaaccagtataaagtttatccacaaatctttgctctttatcagaaagtccttctgtgtggtcctttaaggttgtttgtacacataattttctctttaagccatctgacagcagcatccactttgtacaatggagtccaagagaattaaacggctgagcacatgggattcctgatccgagatgagtacttgagtgaaagatgaagtggtaacatcggaaaggtgctcttaaaaggccttttaggaaatgctggtgaggatgtggtagcagcatgggcatattcgttttatttgtaactggagaaaacactggatgcgttttggctcaatgtgattgtgacctcc

SEQ ID NO: 276207 - DNA, 934 bp, Homo sapiens
tcctcgatagtcgacaacgaaatgagaggaatgttaggtgggttcggcattacataaatcactcactctgtggacaagagccacgacaggcagcctctgctacatcttccttacggcctggcaaaagcaatctccctaaatgccctcggttggcttccgttccatttcccacagcagctattatgaacattcactgtcccataatctccccgcttgatgaggactacagcacctacttcacagaggaaataaaggtgctaatgcagccaggaaacacaacaggagcaaagaggggcctggccttatgcatggaagctgaaggactgaaatttgcatttgatcatcttcaacttctggcacctgttgtcgcagttttctgagtgcccactgagctatccacaagctggcctcctctgaggagtacaacactcccaaactacttctctcagcttccacctaactctgcagaactcccttcctttagcgagaccaaacttagctagcagttagaggtcacccaactgtgccaattcctactaaattgtaacagaaagcccccagacctctgcaattgaaaaagaatcagccatacttaccaccactagtacaagaagaagggtccacagctagcacagataatttgtgccctctctcagtaagcatttttccaaaatattctataaatgttgattttccagcaccagggggcccagacaatcctacggtggaaagagatcttctaattcaatgaaacaaatgaaatcagaactacgatcagttttactgagtaaaatattagactaccttctatttcccctaagtgtattaaaaccaccaattaatatatttcaacatgtcctaaaaggggaatagaaagtggttctctaaaaaaaaaaacacggcctccttggcctagggggggaccctcgggacc

SEQ ID NO: 276208 - DNA, 410 bp, Homo sapiens
gagggtagaacactgaccgaatcccagactcactacctcaggggctgagatgggtccaaaggggcccttaacctctcacttgatcacctgactcttaccgctgtcattgatctgacatgttctcctgggcgctgtcccagctctgtcccagcttctcagcactgtgtcctggtcagccctgagggctcatttcctttatccatactgaggaccaagacctgtctttcctgtagggcagtgagggccacgggctagtgcctgagccgatgagtgcactgctggtactgtgctgagccctggacaagggtgtaggttgctctaaaaaacaacttcccaatattctacaaaataacgttcaaactgaacagagcttgactgaagattcttcttacttcatttgttttcatgct

SEQ ID NO: 276209 - DNA, 891 bp, Homo sapiens
ggtcgactaccaggctgcgttaggagctaccgtcttcagctttttctcgctgctgagagctgtttgttactcagtaaaactcttctccaccgtgctcacccttcagttgaccgtgcaacttcattcttcctggacataaacccgggacccacagaacagcgggtgcaaaaagggctgtaacgctttcctggccggatcgccaagctgcaggggtttagatagctcatggttctgctggttaggaagttcaagcgcaaggccctgacttctggtaagtgctttcatgctgcatcaacacgactaagaaggtcaaagaagaagtggacatctttcaactgatgaactgtacagagagaggagcacttttggaataatcctcacagcctaaaggccaatgatgacacagatggtgatgtttttaaggaggtgatgatagaagatatttgatcccttggtttggagtctaccaactgagataaaggagaagagctgagaagccttgtaacattagtattctttgtctctttgtggatgacctttcacatttaatatcgaacatcagaaactgaattcacgaaagcaagggagagtcacaccttcctttcataaatctcttgtcagtgcacctttgagccacctaggagcccaatcagactcccttaaaatagtcttgggtccagttccgcgcacatcggagccgcaacacgcggatccccgaattggtcctaaagtccttaaatagttgcacacccagagacttcgtcgaacctctcgggactcgcccggcaggttaccattctcacagtgttccacaaacgcctggcgaacactctcgtcgcaaccacactctattcgtgaacaccaccacagcaaagaacgggttctccttgc

SEQ ID NO: 276210 - DNA, 288 bp, Homo sapiens
  misc_feature (209)..(209): n is a, c, g, or t
  misc_feature (227)..(227): n is a, c, g, or t
ggagtttgaaagaataaagagatggagggaacgcatcataacctggtatgacctggatcaacataaacaaaggggtttagatagctcatggttctgctggttaggaagttcaagcgcaaggccctgacttctggtaagtgctttcatgctgcatcaacacgactaagaaggtcaaagaagaagtggacatacttcctttggcctggagnaaacttaggagcctgccntttcagtgtcatctcaggagcatccttgaaagaatcagggaagaaagtgcagaaatcagag

SEQ ID NO: 276211 - DNA, 240 bp, Homo sapiens
ctctgtctctattaaaaataacaataataataatgaaatacttaaaacccaagaaaaaaatcttgaaagcagaataaaaaagatttatcatatatgaaggaatgccaataatattaacagctaacttctaattagaatcgatagaggacaggaggcatgaggatgtcatattcaaagtgttgaaaatggctactcaggaggctgagttgggaagatcacttgagcccagaatgtcttaga

SEQ ID NO: 276212 - DNA, 428 bp, Homo sapiens
cagtcacactgatgaggcaaaaacaattctctctggtaaaactggtttaaacgtggcaataaatcaatctaaaagcaacttaaagattctttcatttctttttctgacagattcacctattgacattatgaaatttctgtgtaacaagtaactatttggtgtgttctatcaggtcaagcttactcacatcttaaatggtttcaacatccaaattcctaagcaaggcttcaaatgaagaaagaaaatatcaacatatgctagatcgttcaaagtgaccttgttttaattaaccatttgaaattttttttactatacatcacaagtacaactccttcctccccaaattccaccactggtcatttaacaaacccattttatatggcaaacatgaatcttctacatggtacaccctttcccaaaaaactgtc

SEQ ID NO: 276213 - DNA, 388 bp, Homo sapiens
atggccacaggtggtcatctagcttccttcaaattcacttatctcatggatgtgattagtgggggcctaacattttgtttattttttaaagtagaattaggccgggcacggtgactcatgcctgtaatcccagcactttgggaggccaaggcaggaggatcacctgaggccaggagtttgagagcagcctggccaagatgatgaaaccccgtctctactaaaaaaaaaacacaaaaaattagccgggtgtggtggtaggtgcccataatcccagctactcaggaggctgaggtggaagaattacttgaacccaggagctggaggttgctgtgagctgagattgccccactgcactccagcctgagcaacagagcgaggctcccatctc

SEQ ID NO: 276214 - DNA, 197 bp, Homo sapiens
tgtggatggaacagagttagggaagcaaagaagtggcagctagatgaatcagaaggggaagaggcagatagtgtgcagggccatgtagagccaatgcaagaacttttactctgagatgagaaaccagtggacgggttttgtttctttttgagacagagtctcgctctgtcgcctaggctggagtgcagtagcacgat

SEQ ID NO: 276215 - DNA, 413 bp, Homo sapiens
ttcaaggaaaaacgtattagtttgttatgttaaattaagccacccacacacccacactagaaactgttttgtgttggaaacaaaataaatgacttcatttccaagcccttcctatacttcatcaccaaaccttaaataatagcaaaggaataagcatgggaaatgagaaaaataaagtactagcagcagtagtaatagaattataataacagtagtagtaataaatattcaaggagttttgtccaccttcggagctcaggctgtgaaccacagtggtttacttattgaaaatcatcacgaggccgggcgcggtggctcatgcctgtaatcccagcactttaggaggccaaggcgggcggatcatgaggtcaggagatcgagaccatcctggctagcatggtgaaaccccatct

SEQ ID NO: 276216 - DNA, 489 bp, Homo sapiens
ccagaccagtccctttcaccagtattacttttatgagcaattaaaatatagaactaataataatatcatttatgaagtaatataacattataaatatatactatgtattatacatttaaactataataataataaaactggtcattagagtactttttgcctagaaatttcctccgtgtacttttttaattgtggtgagattcagctgtactctaaaacatgtaattatccactgtgagaaataaaagatagttaagtggttcccaagaacatattagacactttgagctaacatgagaatgatttcatgtcaaatgagatgaactctatggcttcacaaatccacttgtctttggcacagggaaaatgaatctttttaatatctgagagttaggttatagagattcatccattataaatttaaacttattatattacacaggttaagaatattttttccatcaagggccactgaaccagagggttaaa

SEQ ID NO: 276217 - DNA, 983 bp, Homo sapiens
cacctgtttattgaatatttacctcccatgaagtctttcagcctattggtggtattttactgttcagatatatgttagaatttcactgatacttactgggcgcggtggctcacacctcctaattatgttttattccacctgcccctatgtataagcgttaccaccctaattatgctttttgtttttcggtttttttgagacagagtctcactctgtcacccaggctgtaagtgcaactccaactcaaaaaaaaaaaaaaaaagtatatatttgttgatttgcacatcacctaagaaaaccataagctaagaaggtttggactcaggcgtctggaaagttggtcaccacctctaccccacctcatatctgaatgtcaagagacacgtagaggcagagaagttaaagcaactttctagagacagaaatgaccactgatcaagccacaatgcactctggtttaaatgacatttaggtcatgactgtccttaatctaaaacaaacctagattagtatttcttttcattagtaaatagctaaattctgatggtaaattatgctgaccaaaaacagttcctcacttcccaagttagacatagcaattagaaaaataatctaagcaagctccatttgtatttcttttttcacctgtttattgaatatttacctcccatgaagtctttcagcctattggtggtattttactgttcagatatatgttagaatttcactgatacttactgggcgcggtggctcacacctgtaatcccagcagactgcaatttctgtgaacaagatacaacttattcttcatagcaactctgacaaagttgcaaaaggtatatatatgttggccaggtaaggtggttcacgcctgtagtcccagctacttgggaggctgaggcaggagaatcgcttgaacccaggaggcagaggttgcagtgagccaagattgcgccactgcactctagcctgggcaacagagc

SEQ ID NO: 276218 - DNA, 427 bp, Homo sapiens
agcaatcaggcaagagaagaaattccaaccaagaatttcatatccagccaaactaagcttcataaacgcagaagaaaaagatctctttcagagaagcaattggtaaggaaatgtgttaccacaaaattaaaaaaaaatcctatccaaataagaagagagaaagtcaaattatttctttgcagatgatatgatactatacctagaaaaccccataatctttgctcaaaggctcttagatcttatgaacaagttcagcaaggtttcaggatacaaaatcgatgtacaaaaatgagtagcatttctatacactaacaatgtccaagctgagagctaaatcaagaatgaaattccattctcaatagccaccaaaggaataaaatacctaggaatacagttaaccaggaaggtgaaagatatctgcaatgag

SEQ ID NO: 276219 - DNA, 840 bp, Homo sapiens
gagacacagaaagatatttgctatactagaagtttacagagtttctcatatcctcctcaactttcttgttttcagtactcttttcaattaggaatgataggaaactgtatttcttttccttgatggagtaacaaagggtgataggaatactccttatttaataatgatgtatgttatacatccatggtcttcttggtcgttcattcctgagctagtttctaaattagaacttgattcatctaaaaatggggtggattcttaaactagggacttacaggaaaaggcaaccttttagttttctgcatattgtattcaactctggaatcttgtgtccagttctgggcatgttcatagatttaattcatgtcaacaaatatttactcagtgccactttatacataaaacactaccctaggactttggttgtccaatcaagatcctatcacattctatattatgcaaataactagactttttacaaactgaatggctttccctggcctcagtgtatttacaaactagtagaagagacaaatacagaaacacataattaaaatacagaaaaataaatacaaaattagtatatggatagcatatgaaaggtaaaggaggtcccaatcccgccctctagtcatggaaaccacgagttcgttattaatacaaagtcaatggagggtaattgagtgacaggaagagagacaggtgctgggcagaaaccacatcagtgcacttgtgacattttatttaatggtaaattctatcatattcatggtaattgcctgtgactgcaaaatgaggaaaggttacatgtatttgtcttctcatcattatcaccactgt

SEQ ID NO: 276220 - DNA, 249 bp, Homo sapiens
gtttccactgtcttgctattataaataaggctgttatgaatatccttattacaagccttttgtggacatacattttctcatttctctcaggtaaatccctacatatagaattgctggtcataggttagatgtgagtttaacattagagaaaacaccaaacagttctccaaaatggttgtaccattttgcaccctccccagcaatcttcgagggccccagtccctctacattcttgccaacatttgtcag

SEQ ID NO: 276221 - DNA, 381 bp, Homo sapiens
gaaaaagaaagaaaagaaaggaaaacaggaggcacatcaactcccattttcagcaattgaggattattaacactctacttgaaaatcacacatcagctgtgcacagggtggctcatacctgtaatcccagcactttgggaggccgagaagataggatcacttgaggccaagagtttgagaacagcctgggaaacataggaagatcacatctctacaaaaaaataaaaaaatgaactgggcatgatggaacatgcctgtagtcccagccactcaggaggctgaggtggaaggatcccttgagcccaagaggtggaggctgcagtgagctatgattgtgccactgcaatccagcctgggcaaccttgaacaagatcctgtctc

SEQ ID NO: 276222 - DNA, 418 bp, Homo sapiens
  misc_feature (32)..(32): n is a, c, g, or t
ccgtatggctgtacctaaatggctgtacctanaatggctgtacctaaactggctgtacctaaatggctgtagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaacccagacggaacaacaatgttgggacttctccatcctgtgga

SEQ ID NO: 276223 - DNA, 965 bp, Homo sapiens
ctttttcgtcttccaggtctactgttgcctctgttgtgctagggttatttcctccaggaatgtcatctgtttgatcagacactacttcatcagtcttggctgaaggatcaccactacctttctgaagaatctctgtggcttcatactcaagtacctcggatggagtcagaggttccaaatgaatactgccttgctcgctaacatcagaactaacagattcaggttcatgtctttttctcaaaaactgatcaatgcttacattatctgatgctaatcgcaaatccttaatattctttgaagaaaatctggcttcactggagttgtgatctttaatctgatcagataagattatgttttctgaactttggcacatcttcaactccatttcctgacaaacgtgttgtatttgttttttcttttccactttatctgcaccaatatttgaatcacaactgacgatgttttttgagccagtttcctggtctgcaagacaggtttcattttccttatctgaaactgttatgctttcttcactttttgttgttgatgagccttcaaatgaatttgcattacatccatttttttcttttgaagaagcagctttatcttgtttactgaaaaataaagtcatttattatgtatttcttcataaagcaatgtttttgaacactgtcaaaataaagacgtgttctaaaaaataaaaagtcaaggtacatttgcccaccaaaaaggaaaacagtccaagttcccaatcctcgctatggcagtaaaatttaggaggaggccattttcttaggcaagattctgagaaactctggaatcacatactaaaagatatctatcaactagttttagtcctggctgtcattattttcatctgttcatatctcttgcctgtttctagtttaaatttaagtatttttattaacttgtaaaagtacctaaaataaaaaaatatatttgga

SEQ ID NO: 276224 - DNA, 792 bp, Homo sapiens
ctttttcgtcttccaggtctactgttgcctctgttgtgctagggttatttcctccaggaatgtcatctgtttgatcagacactacttcatcagtcttggctgaaggatcaccactacctttctgaagaatctctgtggcttcatactcaagtacctcggatggagtcagaggttccaaatgaatactgccttgctcgctaacatcagaactaacagattcagacacaaaacccaaggatatgaaggattgactgtactcctacattactatattaacaatgtggtttatcctgcttttgacctatgaccaagatcagcttggtggaacaaagacactgacatttcaaggagcaatggcaacataaaataaacaaagaaagttcaagaaatcagaagaatatgaaacaatagcgctcagtggattctaagtgtgtggtataaccaaagataactatcaatgcctttagaaaattttatcaacagttctttcagtatagtaaaattgtataattctctttattttcaaaagaaaatattagaattataaaaatcatatactgatttcaagaattccagtggttaaaggaaatttacttcaaaactaaaaaagtgttcattcctttaagagatagcttagctatctttttaatattcaaatattgttggcgagccttatttttgttctcattttacaatgcaaacgcatcaaggtttcctctggacaccacctttccactgaaataaattcagcaagagaacaatggctaatcatacttctggtctaagaataca

SEQ ID NO: 276225 - DNA, 420 bp, Homo sapiens
actcctcttcttggagaacacagaggctcccgcctcgccccagggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactgatgccccatggatcttgaatcccttcgatcctttgctgcctgatcggtcttcctctgcttccctcccagagcctaaagccagcaaactttcccccggtgtcccctgttctgcatgcccccacaacaccaggtgactccaggaggctcagctgcccgggctgggctgcaagtgggagacgtgattctggaagtgaacggg

SEQ ID NO: 276226 - DNA, 2806 bp, Homo sapiens
actgggttgctgatccagctatggagaaagccgcagatctgcaggacacagcctcgttaactctgaagtttaagtttaacccaaagctgggcattgataatcctgtcctctccctggccgaagaccacgacccctatgatccctggagcctggagccgcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatggggtcagtgtggagaagttcactcacaaccaactcaccaggaaggtgtgactgcctgtctcccactctcctcccccaatccgggcctgggccccacctcgggaagacgcctccttccccatgcgcctaacctccttatctggtctcctacctttatcaccatcctccccctctacagtttgtgccaggctccacttagtgcctgggaggaggggctgtggggggagcatacctcttctctccctgcccaggtgttatactgatgccctgctgggtccccacagctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggtgagtgggagccctgggggcggtgggggaaggtgggccttggggtgggcacacaagcgtatatacacctttcagtgcaccgaagaggtgtccctgtctgagctctggccctgggccgcctcttcccgttcactctggggtcagtcccctggtgtgtacacagtggcctaggatagctggagaggagcagtgaggatgtctatgccccaggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggtgcgtgctgaggggcaggggctagggttggggcaggagtggggcagggctgaggtccgaaagatttgctctccctgccaccttccaggttcgcctgtccccactcctcttcttggagaacacagaggctcccgcctcgccccagggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaaaaataaacaacaacaaaaacaaaaaaagaagaaaactaaataaaaataaaaataaaaataagatccacttctc

SEQ ID NO: 276227 - DNA, 249 bp, Homo sapiens
aattttaagaggtggagaaaggcgtatcagattctccaacgaaaaagaaactttataggttgaaaacttttaaatgcttccaatgaagatctgatcagcatgtttccctacattccttctatgtcgtgttggcatcactggaaagagcctcgcctaatgtggtggcttacggaccagcatcaccaacgtcacttgggaacttgttagaaatgcagaatctcaggcctccaccccagacctactgaatca

SEQ ID NO: 276228 - DNA, 479 bp, Homo sapiens
cattgaaaggatttatattaaataagacataaatccacaaggacaaagatggcaggagaaagacagtagcaaccaacttcttgaagttgcagaacaggtggcctgtggtaaattaattggcagacctgagaatattaaatcctgtgtcagtaataggggaagccaagaaacaacctgacttaaattaatgcgggttctctaaaagggttagaaaatttcccataccaggtagctacaaaagtaggaggtgatgatggggctaaaaacaggaagactgtaagtctgtttaagaactagttagagctctgttgccactggccactgctttttcaccctagaaaatggtgaaagtaaattaggcgggttctggcttggagtcaccaacacgtctgagtgcagagatgctgtcttgaaaacagagggattaaaggagagttttcatactctttgagcaggaagagagtcttttgaattccagg

SEQ ID NO: 276229 - DNA, 182 bp, Homo sapiens
ggcagttgtgtagcagctaatggagatgactggggttgggtaagattgggaaagcaccaataaagagtagaagaaagctagcagcccacatacttgctgtcatgtcagttgtaataacattgtaaatgtagattttgtatttcattgtaagaaattattaaagtgatataaagaaaataatg

SEQ ID NO: 276230 - DNA, 3018 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276231 - DNA, 436 bp, Homo sapiens
ggtggaaactaattctaagccagactgctggagatcaccctgttctagtgtgtggaggcttccaccagaaggaaactgcaccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276232 - DNA, 3089 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagcaaaaaaatataccttcaatatacaatacacacacaccccgggccacttatcgcgggccgacaaaacggttt

SEQ ID NO: 276233 - DNA, 3137 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagccatgattgtcttgtgtcttctgtctgcgcaactcccctcaaacaattttgttcctctggggtcctgagtatcttaattctgggataacttttagactaagaaaaaattgttttctccag

SEQ ID NO: 276234 - DNA, 3908 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagcaaaaaaaaaaaaaaaaaaaaaaaaaaaaaaaaaaaaaaaaaaaaaaaaaaaaaaaaaaggggggggcccaaaaaattcctcacgcggagagagccccacaaatttattccgcgctcacccccggtttttttgttgtcaaaaaggcgggcccccatatgaggagcgctggtattatataatagcacaagaacgacgccgggcgcgggggttaaaaccaaggtgttggaggggggacaaacggtgacacctgggacatcctcttgtgggaaaagcacccatttttcttggggcgggcacatactatatgtggaacaacatcacccagagaaaaaatttaaaaagccctagaaggaaacaataattaaaactttgtggaggggggtctagcagtggttgtgcaaaaccgacgagtcgtgattgtgtgggcgcgggggcagaggaaaatttgggccacgaaaggcgagtcattgtttgtgctgcagcaaaatatttttttcagcgagacttggtgtaataataccgtggagagaagagagaatagatcagaacgataacagaaaatgaaaaaatgagaaacctaagataagacgaagaaagtactgagaagaataagaagaaataaaagacaaatagaagaaaccaaagcagaaaaggagaaaagaaacaaccaaaaacgagaagaaaacgacatagcagaaggaagaaaggacaaaaggcgaagcaagagaacaaggagaaaggaacacgacaagaatgagccaggacaaaagaaaaaagcagagagcaaagagccgacacgagacaaggaagcgacaaggaaggaagaagcggcaacaagagcgggcagacgaactgtcagacaaagcaacaaacaccagaaaaaaaaagac

SEQ ID NO: 276235 - DNA, 2659 bp, Homo sapiens
gaggataaactgtcagcggattgcacgattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276236 - DNA, 2662 bp, Homo sapiens
tgtaaatctcttgacatacaaaggttcttgataggtcaaagcttgtacaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276237 - DNA, 2651 bp, Homo sapiens
cacggttgtccagggtgaggaggagctggtggtggaatgctctaatcccagcttgagtagcccctggacagtcaggaaggagcctagctaagtttccttctgcatttttctctgcaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276238 - DNA, 2693 bp, Homo sapiens
  misc_feature (2681)..(2681): n is a, c, g, or t
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctcccctccccgggatacagggngaccgagctcga

SEQ ID NO: 276239 - DNA, 2770 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccctgagttaactcaggggcgagctgctgattgtgaatctcagagtcttaagagagaagccacatatattcctcttgcatagtattgtggtgtgttgaattcaatacg

SEQ ID NO: 276240 - DNA, 2641 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctcaccaagacctgggaccagcaggtggccgagctg

SEQ ID NO: 276241 - DNA, 2928 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276242 - DNA, 2785 bp, Homo sapiens
  misc_feature (52)..(52): n is a, c, g, or t
  misc_feature (279)..(279): n is a, c, g, or t
  misc_feature (324)..(324): n is a, c, g, or t
  misc_feature (464)..(464): n is a, c, g, or t
agattggcgagatttaccatggattcgtctgacctaatgcttcagtgacctnggtattttctgcaacgaagcaggttgcgtaatgccttggcatccgggctgtgtagacataacggaacttcaaccgggctggtgatgttggagccgatgcgatgagctcgcatagatatcgttgcctaccccggtgtcactctaaggtgaatatccgatggcttgagctattggttggtggtccgacaatcatgatgggcactacagctagcctatattcggagcatnttgacataggtgctggtcaacgcgtgtacaactgtacaatactantgtagaggcttgctaatgacattggatggtctagatgctcacgaatgtgtaatgactgagcatgtatgggaacgtattttgcatgttggatatataagggagtcacgaactagtcatctatacaggatggccagcgtganatgaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276243 - DNA, 2180 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcaggaggagacgggatcactcaagaa

SEQ ID NO: 276244 - DNA, 1848 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaactctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276245 - DNA, 1678 bp, Homo sapiens
tgtaagtggcccgaggcgttgaatggcccggaggcgttgaatggcccggaggcgttgaatggcccggaggcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276246 - DNA, 1212 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgaatagcgagggatcctctagatc

SEQ ID NO: 276247 - DNA, 2034 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggctttcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagcaaaaaaaaaaaaaaaaaaaaaaaaaaaaaaaaaaaaaaaaaaaaaaaaaaaaaaaaaaggggggggcccaaaaaattcctcacgcggagagagccccacaaatttattccgcgctcacccccggtttttttgttgtcaaaaaggcgggcccccatatgaggagcgctggtattatataatagcacaagaacgacgccgggcgcgggggttaaaaccaaggtgttggaggggggacaaacggtgacacctgggacatcctcttgtgggaaaagcacccatttttcttggggcgggcacatactatatgtggaacaacatcacccagagaaaaaatttaaaaagccctagaaggaaacaataattaaaactttgtggaggggggtctagcagtggttgtgcaaaaccgacgagtcgtgattgtgtgggcgcgggggcagaggaaaatttgggccacgaaaggcgagtcattgtttgtgctgcagcaaaatatttttttcagcgagacttggtgtaataataccgtggagagaagagagaatagatcagaacgataacagaaaatgaaaaaatgagaaacctaagataagacgaagaaagtactgagaagaataagaagaaataaaagacaaatagaagaaaccaaagcagaaaaggagaaaagaaacaaccaaaaacgagaagaaaacgacatagcagaaggaagaaaggacaaaaggcgaagcaagagaacaaggagaaaggaacacgacaagaatgagccaggacaaaagaaaaaagcagagagcaaagagccgacacgagacaaggaagcgacaaggaaggaagaagcggcaacaagagcgggcagacgaactgtcagacaaagcaacaaacaccagaaaaaaaaagac

SEQ ID NO: 276248 - DNA, 1413 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgcccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276249 - DNA, 1214 bp, Homo sapiens
gcccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 276250 - DNA, 1687 bp, Homo sapiens
gctagtacgaggctgggtgttagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggctttcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagcaaaaaaaaaaaaaaaaaaaaaaaaaaaaaaaaaaaaaaaaaaaaaaaaaaaaaaaaaaggggggggcccaaaaaattcctcacgcggagagagccccacaaatttattccgcgctcacccccggtttttttgttgtcaaaaaggcgggcccccatatgaggagcgctggtattatataatagcacaagaacgacgccgggcgcgggggttaaaaccaaggtgttggaggggggacaaacggtgacacctgggacatcctcttgtgggaaaagcacccatttttcttggggcgggcacatactatatgtggaacaacatcacccagagaaaaaatttaaaaagccctagaaggaaacaataattaaaactttgtggaggggggtctagcagtggttgtgcaaaaccgacgagtcgtgattgtgtgggcgcgggggcagaggaaaatttgggccacgaaaggcgagtcattgtttgtgctgcagcaaaatatttttttcagcgagacttggtgtaataataccgtggagagaagagagaatagatcagaacgataacagaaaatgaaaaaatgagaaacctaagataagacgaagaaagtactgagaagaataagaagaaataaaagacaaatagaagaaaccaaagcagaaaaggagaaaagaaacaaccaaaaacgagaagaaaacgacatagcagaaggaagaaaggacaaaaggcgaagcaagagaacaaggagaaaggaacacgacaagaatgagccaggacaaaagaaaaaagcagagagcaaagagccgacacgagacaaggaagcgacaaggaaggaagaagcggcaacaagagcgggcagacgaactgtcagacaaagcaacaaacaccagaaaaaaaaagac

SEQ ID NO: 276251 - DNA, 3093 bp, Homo sapiens
ccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaactgtg

SEQ ID NO: 276252 - DNA, 2180 bp, Homo sapiens
aaaggtccactgtatagtttatagaattagttttttagtggagttgatgatgcctttccagttactaaaaaatcttcatttagcattcagtcgtagtacctgggaatcatggaggtaggggagtgaatgaattgccatgtgggaggaagtgagagtaagtggaaagtggcttttccaggctgacatttgatgccattgggatctctgatttttttcctctctccctcccctccccctgaggaaacaatgcccttttgataataatttgctctctgcctgcctgacaagtactcagctgagatttctcagccaacaagacagtacaaacacttgcggtaccaagcaccactttctcaaaccctggcctcattgaggtgataacaactgtcctgctcaagggattccccctttccccctcttcctcactccttcccccacctcctcttggtgttatacagggatatcatgtccatttataaggagcctcctccaggaatgttcgttgtacctgatactgttgacatgactaaggtatgtaacttgatgggggtttggggggttttgggaaattgggggccataaggttgcaaaagcctaaaagagattattcagctcacctctccgattacacagatgaagaaatcaagaccccaggagagtaagtggcttgtccaaggtcacatagtgaggtggagcagcactttgaagaggtgtctgttattagtgtaccccataggtactgattggcttggaaaatcccagttcatgtctgttgtcgcagcttgactatttatagggcattctttcactctcaaaaatgctcctgtttggataataaattatatggtcaccctatccattgtactacccagctcttcccccatcccgttactcttgacattaactatgctatggtactataaatcagatgtagggaaggttgggaatagggcaagcttgactgaagtgtttgtggttaaaggactttgctcaggatcctgtccttactggttgcgtttaagtatcccttccaccccaaagactatacctctcttgtcctcctctcagagagaaagcttaatacataaggtcacatttctctggcatagatacctaggtttctctgtcactgaatgctctacccacagaagtgcagttgcacttaaactgatgttagaaagaaatcatatttcctaaacctaatgctgtttaagtgaaacacatagttttcttacagtaaatttcttacagtaaaaattcagattttgtattgttggtgtatctttttttgttgttttgaatagatttcccttcatattttttttttatgtagttagaaatgtttttcctaggacatctcgtcctcagtcaagtaccagtgttaatagcctagtacctggggtcccagagttgatgccatgttgagaccagttgagtttactattccaaatgactgagagccagaatatgacgtagggtcttgccaggagggcaaggtgggaactatagacttaggcattggattgccacgtccctttccttttgctgttcaaatgcttagcagacctaaatgcctaggagcctttgtggaagaagaaatataactgagtcagttcaggttttcctcccttcagggggggaagtcctgttgaagaattatggcttgagggggaagagaatttagtgtcgttttcaggacggctgattttttttttttttttttttttaaacagtattggggaaagttctgggactggtctaatggctctgagtggaccctgagtcttccccattttcagtcatgatgtgctgcctgagccacatcctccacaataggtttgatcctctgcagaggaagcaagcagataccctaggcatccatcacaccccctaaccctgctgtgttactggcactgggctgtggcctccaatccctttcttcgtctcctttcatcatactttcccttcgtgccacataaatgtagggtggggttgcatcatatgcatgtttggcctgggcaaatccaaacatatattcagtcaaaatctgtgtcgatttctcaaaattaaaaacgctagggttatattttatagataagcatattatatttttccacagtggtgttttatccattatatgtaacactgatcagggaggtctgcacaaaaaaaaaaaatgc

SEQ ID NO: 276253 - DNA, 388 bp, Homo sapiens
gaatctcagagtttgaggactatctttctgaaataagtcaggcaaacaagattagaggaaaaaagaagtaaaaggaatgaacaaaacctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaactgtg

SEQ ID NO: 276254 - DNA, 3050 bp, Homo sapiens
ccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaactgtg

SEQ ID NO: 276255 - DNA, 3145 bp, Homo sapiens
aaaggtccactgtatagtttatagaattagttttttagtggagttgatgatgcctttccagttactaaaaaatcttcatttagcattcagtcgtagtacctgggaatcatggaggtaggggagtgaatgaattgccatgtgggaggaagtgagagtaagtggaaagtggcttttccaggctgacatttgatgccattgggatctctgatttttttcctctctccctcccctccccctgaggaaacaatgcccttttgataataatttgctctctgcctgcctgacaagtactcagctgagatttctcagccaacaagacagtacaaacacttgcggtaccaagcaccactttctcaaaccctggcctcattgaggtgataacaactgtcctgctcaagggattccccctttccccctcttcctcactccttcccccacctcctcttggtgttatacagggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaactgtg

SEQ ID NO: 276256 - DNA, 2832 bp, Homo sapiens
ccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaactgtg

SEQ ID NO: 276257 - DNA, 3032 bp, Homo sapiens
ccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagcctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaactgtg

SEQ ID NO: 276258 - DNA, 1582 bp, Homo sapiens
ttttttgcgcgaccatttctttattaaattatacaaaaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaactgtg

SEQ ID NO: 276259 - DNA, 2679 bp, Homo sapiens
ccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaactgtg

SEQ ID NO: 276260 - DNA, 2385 bp, Homo sapiens
ccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatggggagcagcctggggttggtcgtcgtcgacgtctctgtacgcgaactgggcccttacccgtggatcgcaccagatacgacgggcgtggcggccgct

SEQ ID NO: 276261 - DNA, 2194 bp, Homo sapiens
ccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccgcgatacggaggggtccttagagcagacctacataacg

SEQ ID NO: 276262 - DNA, 534 bp, Homo sapiens
tctggcacaatgacaacaagagcttcttggtgtggttgaacgaggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaactgtg

SEQ ID NO: 276263 - DNA, 1127 bp, Homo sapiens
ccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctagggtaagaggagacttttaagtagccaagtcggttgttagcagataattactctaggtcagcctttatcaaccggagtccctcatctgaactacagaacacagaaaatgattgagtgactcttctcaaatctcctcaggatggtatgtgactagtatcattctagatgcagaggggagaagttaatttattacagtggtaacctttgagaagtggttctcttaagagtgtggccctgagcatctgggaacttgtagccgagcagtttctggggccctatcttagacctacaaaagaaactctggggttggggccaaaaatctggtttttttggttgttgttttttgtctcaaaaaagaaagaaaagaaaattcttaggtgttcctagttgactgtattagctttatcagccatgttttttttttcctctttacctagaaaacaatgttgggctgacttactg

SEQ ID NO: 276264 - DNA, 371 bp, Homo sapiens
  misc_feature (2)..(2): n is a, c, g, or t
tnctgagccaaccagctaaaggatcactgcagctaaatacagatagagaagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagagcatgtctggcatagcagcctgacttttatgccctaatcttgagttgaggaaatatatgcacaggagtcaaagagatgtctttatatctgactgtatataaatgaagtttttttgttttttttgttttcctttttggtgcaataaagtttgttttggcagaaggagaaaaaaaactgtg

SEQ ID NO: 276265 - DNA, 3021 bp, Homo sapiens
ccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccaggagacagcaaaaactataatgaatgtatccggcacgagaccatcagagttgcagtctgtgacatgatggaaggaaagtgtccctgtcctgaacccctacgaggggtgatggagaagtcctttctggagtattacgacttctacgaggtggcctgcaaagatcgcctgcaccttcaaggccaaactatgcaggacccttttggagagaagcggggccactttgactaccagtccctcttgatgcgcctgggactgatacgtcagaaagtgctggagaggctccataatgagaatgcagaaatggactctgatagcagttcatctgggacagagacagaccttcatgggagcctgagggtttagaccctgctcccatctccccttcccccactcaagagtcccagcagaatcccttccccccaccccagggatggagaggcactgtgtatctccctccagactcgaagtcatcctgcaagatggcaagaaccaagcaagctccgatcccagggtgtgggagtgggggcctgttcccggtctgacctccttggcactggagcatctggggcttcgttcatccattcatcccgtatcaggggccaaggtacctttacaggagcacctagagcgagggcctttggcaaaaacaaaacaaccaacacacctctccacagggccagctccttagggataagtggaagatggaaattgcaattccaagagggagtgtgcccaaatgatttatggggatacctggaagggagcttggggtgggggctgtctgtgacacttaagcagtctgggtggttgtctatttgtctgtcttcagtcttgaagcagggcttcccaatgcccttttcctccctgccttccttcccccattatttcccacaggccagcataattttgtttttcctaatttatagtcactgttctagacagaccaaagagaaggaacagtggtggagtctaggctgctgatcagtaagctttacctagcacctgagcacctttctcccctcccctctttcctcacccttttctagatgtaagacagaaagtaaatgtgactgggacttaaccaaggtcttggtaaagcctgcatggcaccgtaagaagctgaaaatactgtttgttcccgcaatcactgatttgaaaagttcccaacacaggcagctgctgtgtatatgggattagagccactacatagaatagtctcttacagattttcataaatactagtcacaataagggtatttttcttgggggtggagtaagggggagactgatgctagtccttgttgtattttgttgggctgtccttgtgtattttcaccccagcctgtagtcctcctcacttcaaccccagggatttttggggagcaagggtagccaatggcagagggggttggggctgggactctggaggctcctccccttctttctcttccttccgcctcccccgtgcccccagctgctcttgtcactgtctctgatgggtatttgcctggctttgttgcttctctatctgtatttagctgcagtgatcctttagctggttggctcagaaaaaaaaaaatgtgctttaggtgccctgtaatcctgggcatcaagggaatccatccttcccctttttgatatgttctccccgtacttccagatttattgttatggctcccagtgggtattggcgattcttgtgatgcagggcctcagtcagtgtccagccatgcataagggagaggatagtgtgtacctgccctgccctctgctatgaaggtctctgccttgtggatcatgggactccccttggaggatctgtgcaaaggggggctgggcacaaaggagaatgtcctatttgggagggcaggaagcaaaggaactggacagggattggtgggcttggggaacggaagtttatcttggatacccttgaagaggctgggtctcttcacatgaagatcgaaaagggaccctgcttccaatttccctcttccattcctcgagctactccagggcttagaagaatgctcttggtctgtgggtccagtgttgtctgtcatccatttaagtgttcccactttcaagtgacaatcctctccttggccctgccatagggcagagcatgtctggcatagcagcctgacttttatgccctaatcttgagttgaggaaatatatgcacagggagccataacaataaatctggaagtacgtgaaagcatccgca

SEQ ID NO: 276266 - DNA, 837 bp, Homo sapiens
ccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccacgctcagctccgactgggacggcgagcgcaccgcgccgcagtgtctactccggatcaagcgggatatcatgtccatttataaggagcctcctccaggaatgttcgttgtacctgatactgttgacatgactaagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctaggtacatggactggacctgcctggagcccagcccagagcatctcctcagtgctcatctctatccagtccctgatgactgagaacccctatcacaatgagcccggctttgaacaggagagacatccagagacagcaaaaactataatcgccgtcacgagatggtccggctcat

SEQ ID NO: 276267 - DNA, 675 bp, Homo sapiens
attttgagatggggttttattttgcagattcatgcattgatcacaggcccatttgacactccttatgaagggggtttcttcctgttcgtgtttcggtgtccgcccgactatcccatccacccacctcgggtcaaactgatgacaacgggcaataacacagtgaggtttaaccccaacttctaccgcaatgggaaagtctgcttgagtattctagggtaagaggagacttttaagtagccaagtcggttgttagcagataattactctaggtcagcctttatcaaccggagtccctcatctgaactacagaacacagaaaatgattgagtgactcttctcaaatctcctcaggatggtatgtgactagtatcattctagatgcagaggggagaagttaatttattacagtggtaacctttgagaagtggttctcttaagagtgtggccctgagcatctgggaacttgtagccgagcagtttctggggccctatcttagacctacaaaagaaactctggggttggggccaaaaatctggtttttttggttgttgttttttgtctcaaaaaagaaagaaaagaaaattcttaggtgttcctagttgactgtattagctttatcagccatgttttttttttcctctttacctagaaaacaatgttgggctgacttactg

SEQ ID NO: 276268 - DNA, 1653 bp, Homo sapiens
taaacaattccaaaataaaatttccagcacaactaaatattgttgatgataagaggatttttaaaaaagttcttttaaaacagaagcttatatacaacttagaatctaaaaccaatagatttatggtaaaccttaaaactgaaccaaaacaaacaaaaaccaaagttttaatcatttaaaaatcatgtttattgaggtacaacttatagtaaaacctgcccttttcagcgtatagcactgagtcttgacaaatgcacagttatgtaccaccaccgaccaaggcctggcacatttttacctcctcaaagttctccctggctgcttctcccactccttggcaaccactaacctgttttctgtccttatagtactgcttttttcagtgtcatataagtagaatcacactgtacatagtattttgagtctgacctctgtcaactggcataatgcatttgagaattatccatgttgctgtactggcagtgcattcttttttattgctgagcagtattcaattgcatggctgtaccagtttgtttattcatttgccagttgaaggataactgagatcttcctcgtttttagcaattttaaagaaagtttctatgaataattgtgtacaggtttttaattaaatgttttggagatataattcatataccacataattcacctttttaaagtgcataagtcactggtttttaatatattcacaaggtttgtgcataggtttttgtgtgaatactggttttcattcctcttggataaagatttaatttggtattacccttccagacacctttctgtgttttcatacgtatatatgtatgacggtttgaccttaggcagagtagcattttcaaaattttacatggggaaactttctaggtttaaagccattttatttttctgttctgtctggttttatctacgtgttatttacaatctgctgtgtaacaaattactacaaacttaggtaccttaacacatatttatttcacagtttctgtgggtcaggagatcagaaatggttctatttcaaggtctctcacagggctgcaatcaagatgttggcatggctgggtctcatctgaaggctggactggagagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtatgctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctcaga

SEQ ID NO: 276269 - DNA, 1156 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatg

SEQ ID NO: 276270 - DNA, 1275 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaaggtgaccatggtccttgggccctaacatctggacgaagccttgtaaaacagaaatactgaggtgttttaatcctcagaaacatttagattgggacacaaatcttattttttactcttaaatttttcacattttgggggacatggtctatatttttctcagatttctgatatgttgtcttttaaaaatgtgtaaaagttacagttccttttctatagtttattttaaaatgtgggtcaatagtcccactgcttagaataagaggcacacaggatttcaatagaaattgcatgcctttttagatgtgcgaatgtttcattaagcgtatgaatatttgaagagatgtatgacactttaaaaactgtttcctctactgtgttggtggccaggtattaagactgttaataataacaatttagctctccaaatatcctgcatcacaggtgttaaagaggactggaaacaccttagttcttgtattcttgaggatgatttgccatattgtgtctagtatcacggcaaaactccaagtagcattttaaatagtatttatttgggttggaattatttctatgcattgactcatcttcctgggtttcattagctgtacgcattgtactttcttccttaccactatttatctcgaattcttgagattaaagtacagatgaaatctaaactttatctggtaaagttattagttcttacaagtagcaagcaaacggtaaactaaataggatgacctaattgtaccagatttaaaaaaaaaaacaaaaaaccctgattctcctgattctctctacaaaatgctaacatttaaatatgtcatttgtaaattgttaaccagaaggaacatgggaatgactgtaggttgagtttgaagtgtgaagtttgaaggcttagtttgcttgttttc

SEQ ID NO: 276271 - DNA, 3164 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaaaatctgaccacacaaatgctgcagcacccagctgaaatgcatttggatgacaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctctgggttcaagcgattctcctacctcagcctcccaagtagctggaattacatgcatgtgccaccatgcctggctaattttacatttttagtagagacagggtttctcccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaact

SEQ ID NO: 276272 - DNA, 3027 bp, Homo sapiens
cacccaggtagtgagctaaatacctactaaataggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctctgggttcaagcgattctcctacctcagcctcccaagtagctggaattacatgcatgtgccaccatgcctggctaattttacatttttagtagagacagggtttctcccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaact

SEQ ID NO: 276273 - DNA, 3025 bp, Homo sapiens
ccatttattccacttggatctcccacctctaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctctgggttcaagcgattctcctacctcagcctcccaagtagctggaattacatgcatgtgccaccatgcctggctaattttacatttttagtagagacagggtttctcccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaact

SEQ ID NO: 276274 - DNA, 3057 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctctgggttcaagcgattctcctacctcagcctcccaagtagctggaattacatgcatgtgccaccatgcctggctaattttacatttttagtagagacagggtttctcccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaact

SEQ ID NO: 276275 - DNA, 3001 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaatcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctctgggttcaagcgattctcctacctcagcctcccaagtagctggaattacatgcatgtgccaccatgcctggctaattttacatttttagtagagacagggtttctcccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaact

SEQ ID NO: 276276 - DNA, 3158 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcaggtattttcatcgtcgttgcacctacccagaaatctgtaattcagatgggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctctgggttcaagcgattctcctacctcagcctcccaagtagctggaattacatgcatgtgccaccatgcctggctaattttacatttttagtagagacagggtttctcccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaact

SEQ ID NO: 276277 - DNA, 2971 bp, Homo sapiens
tcaatacacagagagctcataagtagcatttgaatacatgaatcaaagtatggaatggcccagtttactgcagcctttttgcaggtgcaaaagatgatcttttagaaagcagaaacagggggtctggtgcatgagatctttttctcaatgtgactgtgctgtgcagaccttcacgtggtgtcttgtgaaagactttgaccactgtgtggactttccttcagtgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctctgggttcaagcgattctcctacctcagcctcccaagtagctggaattacatgcatgtgccaccatgcctggctaattttacatttttagtagagacagggtttctcccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaact

SEQ ID NO: 276278 - DNA, 1366 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctctgggttcaagcgattctcctacctcagcctcccaagtagctggaattacatgcatgtgccaccatgcctggctaattttacatttttagtagagacagggtttctcccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaact

SEQ ID NO: 276279 - DNA, 2022 bp, Homo sapiens
taaacaattccaaaataaaatttccagcacaactaaatattgttgatgataagaggatttttaaaaaagttcttttaaaacagaagcttatatacaacttagaatctaaaaccaatagatttatggtaaaccttaaaactgaaccaaaacaaacaaaaaccaaagttttaatcatttaaaaatcatgtttattgaggtacaacttatagtaaaacctgcccttttcagcgtatagcactgagtcttgacaaatgcacagttatgtaccaccaccgaccaaggcctggcacatttttacctcctcaaagttctccctggctgcttctcccactccttggcaaccactaacctgttttctgtccttatagtactgcttttttcagtgtcatataagtagaatcacactgtacatagtattttgagtctgacctctgtcaactggcataatgcatttgagaattatccatgttgctgtactggcagtgcattcttttttattgctgagcagtattcaattgcatggctgtaccagtttgtttattcatttgccagttgaaggataactgagatcttcctcgtttttagcaattttaaagaaagtttctatgaataattgtgtacaggtttttaattaaatgttttggagatataattcatataccacataattcacctttttaaagtgcataagtcactggtttttaatatattcacaaggtttgtgcataggtttttgtgtgaatactggttttcattcctcttggataaagatttaatttggtattacccttccagacacctttctgtgttttcatacgtatatatgtatgacggtttgaccttaggcagagtagcattttcaaaattttacatggggaaactttctaggtttaaagccattttatttttctgttctgtctggttttatctacgtgttatttacaatctgctgtgtaacaaattactacaaacttaggtaccttaacacatatttatttcacagtttctgtgggtcaggagatcagaaatggttctatttcaaggtctctcacagggctgcaatcaagatgttggcatggctgggtctcatctgaaggctggactggagagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtatgctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctcagatctggcaggctattgtgaggcaatgtgtcattttaccttataacgcagagttgtaacatgctactctgagcagctcatgacatctgcttgaaatttaagttgggcccctagtatgtgtttattataaagattttgatgctgcttttcagagttgggtaacctactttacccccttagctaatgtttcccaaatacacccaaacccacagaaaggaaaactattcctcattaactcacagccaacatcataaacattttatatctagagctgatgatacagtcaggtatttaccaacactcatgtatatatgtagagtttcaagaaataattgcttatccttactagattcaacatattctaatgtttca

SEQ ID NO: 276280 - DNA, 859 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggcgagattgtgccactgcactccagcctgggaaacagcgagactgtctcaaaac

SEQ ID NO: 276281 - DNA, 960 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaaggctgcaatcaagatgttggcatggctgggtctcatctgaaggctggactggagagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtatgctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctcaga

SEQ ID NO: 276282 - DNA, 1329 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaaggctgcaatcaagatgttggcatggctgggtctcatctgaaggctggactggagagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtatgctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctcagatctggcaggctattgtgaggcaatgtgtcattttaccttataacgcagagttgtaacatgctactctgagcagctcatgacatctgcttgaaatttaagttgggcccctagtatgtgtttattataaagattttgatgctgcttttcagagttgggtaacctactttacccccttagctaatgtttcccaaatacacccaaacccacagaaaggaaaactattcctcattaactcacagccaacatcataaacattttatatctagagctgatgatacagtcaggtatttaccaacactcatgtatatatgtagagtttcaagaaataattgcttatccttactagattcaacatattctaatgtttca

SEQ ID NO: 276283 - DNA, 1541 bp, Homo sapiens
ccatttattccacttggatctcccacctctaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaagtgagtacattttcttcctcctcctcctactgtcctccccatcctcccactcttcctctttctctattctatctttaatttatgagaccagaggaggaaggcgctatggtgttgtaaaattgaattctgagttaggacaggatttgattactaactaaccatgtcagcttgagtatattacttcacctcctagatttaatttttttttgttcaaaaaatgaaaggattagatttacaaaatcacttctacctctatgaccctgaaaataagatttttaaaatattattttatatttaacaaggagatgggaagtctaagcattccttttggtcttggcttcttattctgcagggtgaccatggtccttgggccctaacatctggacgaagccttgtaaaacagaaatactgaggtgttttaatcctcagaaacatttagattgggacacaaatcttattttttactcttaaatttttcacattttgggggacatggtctatatttttctcagatttctgatatgttgtcttttaaaaatgtgtaaaagttacagttccttttctatagtttattttaaaatgtgggtcaatagtcccactgcttagaataagaggcacacaggatttcaatagaaattgcatgcctttttagatgtgcgaatgtttcattaagcgtatgaatatttgaagagatgtatgacactttaaaaactgtttcctctactgtgttggtggccaggtattaagactgttaataataacaatttagctctccaaatatcctgcatcacaggtgttaaagaggactggaaacaccttagttcttgtattcttgaggatgatttgccatattgtgtctagtatcacggcaaaactccaagtagcattttaaatagtatttatttgggttggaattatttctatgcattgactcatcttcctgggtttcattagctgtacgcattgtactttcttccttaccactatttatctcgaattcttgagattaaagtacagatgaaatctaaactttatctggtaaagttattagttcttacaagtagcaagcaaacggtaaactaaataggatgacctaattgtaccagatttaaaaaaaaaaacaaaaaaccctgattctcctgattctctctacaaaatgctaacatttaaatatgtcatttgtaaattgttaaccagaaggaacatgggaatgactgtaggttgagtttgaagtgtgaagtttgaaggcttagtttgcttgttttc

SEQ ID NO: 276284 - DNA, 1371 bp, Homo sapiens
accaaatcccaatgaagaccaccaaacttagcatttgggccaaactcagaagatgggtccactgtaaataaattccgggcgaacatattgagtctaaaaacaaaagaaagaaaggaataatcatcctcctcctactgtcctccccatcctcccactcttcctctttctctattctatctttaatttatgagaccagaggaggaaggcgctatggtgttgtaaaattgaattctgagttaggacaggatttgattactaactaaccatgtcagcttgagtatattacttcacctcctagatttaatttttttttgttcaaaaaatgaaaggattagatttacaaaatcacttctacctctatgaccctgaaaataagatttttaaaatattattttatatttaacaaggagatgggaagtctaagcattccttttggtcttggcttcttattctgcagggtgaccatggtccttgggccctaacatctggacgaagccttgtaaaacagaaatactgaggtgttttaatcctcagaaacatttagattgggacacaaatcttattttttactcttaaatttttcacattttgggggacatggtctatatttttctcagatttctgatatgttgtcttttaaaaatgtgtaaaagttacagttccttttctatagtttattttaaaatgtgggtcaatagtcccactgcttagaataagaggcacacaggatttcaatagaaattgcatgcctttttagatgtgcgaatgtttcattaagcgtatgaatatttgaagagatgtatgacactttaaaaactgtttcctctactgtgttggtggccaggtattaagactgttaataataacaatttagctctccaaatatcctgcatcacaggtgttaaagaggactggaaacaccttagttcttgtattcttgaggatgatttgccatattgtgtctagtatcacggcaaaactccaagtagcattttaaatagtatttatttgggttggaattatttctatgcattgactcatcttcctgggtttcattagctgtacgcattgtactttcttccttaccactatttatctcgaattcttgagattaaagtacagatgaaatctaaactttatctggtaaagttattagttcttacaagtagcaagcaaacggtaaactaaataggatgacctaattgtaccagatttaaaaaaaaaaacaaaaaaccctgattctcctgattctctctacaaaatgctaacatttaaatatgtcatttgtaaattgttaaccagaaggaacatgggaatgactgtaggttgagtttgaagtgtgaagtttgaaggcttagtttgcttgttttc

SEQ ID NO: 276285 - DNA, 3111 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaagtcttgtgattgtcatctaaatggttgtctctatacagcaactcatctctagaactgaaaataagtttaaatccctcctccatccccaataattcaagctgcatttcagagaaaaccaggactttggaatcagacagatcaactttgaattcttgatctgcttcttcatagctatttatgcttaggcaagttttgttttgttttgttttacgttgccactcagtcttctcatctgtaaaacagggataataacaccttcctcaaatggttttttttattaggactaaaagagagaatgtgtggaaagatgttagtggaattcctggcacatagttcacatggacaaaatggtgttaactacgaaaatttttacagagaaaagggcaactgacaaaagcaggtgtttggaatgaattaagaccatggcaggcttttgaggcctttatatttctcctgactgtgcaataaaaatattttggctctctgtctaagacttggctgtcacagtagcaatggtaatattagctactgtgccagaagcagcctatcaatagagaaattgaatctcagatgggaatcgagagcatctccttctgccttgctaatagcaagctgatttttagaatatagtctaagtgcttctcttccatcctccccagattctcacctgctacacacccctcagagggactggaggaatccagacaacgatgcgcaggggccctggtgctatactactgatccagaacagagatatgactactgcgacattcctgagtgtgaagggcaggagtggctctagaaaatgttttcatttctgcccttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcagctcaccacaacctccgcctctgggttcaagcgattctcctacctcagcctcccaagtagctggaattacatgcatgtgccaccatgcctggctaattttacatttttagtagagacagggtttctcccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacagacttcttatgcttaaaactcttacacagtgttaaccccaagacagatttgcaattaagtagttaaaataagacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaact

SEQ ID NO: 276286 - DNA, 3354 bp, Homo sapiens
gcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaataggatgagtcatggaatttaagtgatttactgaagattatactactggtagatagaagagctaaagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaagaacatgaggctggttttcttgtcttgcaaggtaattttcaatgccttttagaaaatcatttctggggctgggcttggtggcttatgcctctaatcccagcactttgggaggccaagataggtgg

SEQ ID NO: 276287 - DNA, 673 bp, Homo sapiens
cggacgcgtgggtcgacccacgcgtccgccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 276288 - DNA, 285 bp, Homo sapiens
tactactactaaatttgcggccgcgtcgacagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 276289 - DNA, 3559 bp, Homo sapiens
gcgaagtgaagggtggcccaggtggggccaggctgactgaagtgagtagtgggggtgccagaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaaaaaaaacaaaaaaaaacagaaaagaaaaaaaaaaaaaaaaagaaaaaaaaaaaaaaatagagaagaaaagaaaaaaagaaaaaaaaagagagggggggggaggaaatataaatagtggggggagaaaagaacgttttttgagagagggaacaatggggagatatataacgaagcaggcgcggagcctacaaacaaaaagcgaaaaagaaaaaaacgcatgcgtcgtctatcgaaagaccaccctggtgggggacaacatgaggcaccacccacataatctcagccggaaacaaacaaagttgagcgatacccacgtattcgggaacctgattattattaaattcggagcacaatcagtaggaataaaagaaagagctatgagcataggagacagtaaaactcggaagcgcagagcaagccacacagaccaacgcataat

SEQ ID NO: 276290 - DNA, 1896 bp, Homo sapiens
cagcttcgagacagagtgatagatggaactccttgtggccaggacacaaatgatatctgtgtccagggcctttgccggcaagctgaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 276291 - DNA, 1557 bp, Homo sapiens
aatggatgttgccaaagactttagccagattggaacatccattttagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 276292 - DNA, 1393 bp, Homo sapiens
ggccgtgatcgtatagtggttagtactctgcgttgattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 276293 - DNA, 1968 bp, Homo sapiens
gcgaagtgaagggtggcccaggtggggccaggctgactgaagtgagtagtgggggtgccagaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagcagtccctggaggaggattgtgtgtccattttacagctggagaagccgagatccagaaaggacccccaagttgtgggcagaataaatctacagcagcttttaactattaaaccaacttagattttggtagtctttcaga

SEQ ID NO: 276294 - DNA, 494 bp, Homo sapiens
gttccaccctcaccaagaacactcctaggtatgcagaattggccttcctaggaaataaaaaacaactactttcttagacttcttattatattgaagcttattgaaagaaaaattgcattcgattttagctagcaactagactttaaaagggaacgtggggctataaggattccttctttaaaaaggttctgaaagtctttactatttcccctctctcgttgttggtgactaagaatacttaagcaactattgcaaaatagttgtctagggtttcctacttataatgggttatatcaagtaatattatagttgtttattcaaccattttttatagaatatttttccagttcattctctttttattgtagatttgggagcaaaagcaagtctgccactaacctaggacgacaaggcaacttttttgcttctccaatgctcaagtgaagtcacatctgcctgttacttcccagcattgactgactataagaaaggac

SEQ ID NO: 276295 - DNA, 275 bp, Homo sapiens
gaagtgtggagttagagaatggcctaaatcaggacgtgtcagctattcattgagttcaaaagatacactagtgtgttacagaatgatgacaaaaatgatctctgggactttgctagatgtctaaccttagctcttaagtgcttcagagggtaatcagcttaaaactagccatctaaaaagatgccttcttttttcccacctctcttaaaaatatgtctgaactttgaagttgagtttactgggacctgtgaccactcctgaacatcagcttctca

SEQ ID NO: 276296 - DNA, 3120 bp, Homo sapiens
gcgaagtgaagggtggcccaggtggggccaggctgactgaagtgagtagtgggggtgccagaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 276297 - DNA, 3245 bp, Homo sapiens
gcgaagtgaagggtggcccaggtggggccaggctgactgaagtgagtagtgggggtgccagaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaagaacatgaggctggttttcttgtcttgcaaggtaattttcaatgccttttagaaaatcatttctggggctgggcttggtggcttatgcctctaatcccagcactttgggaggccaagataggtgg

SEQ ID NO: 276298 - DNA, 1313 bp, Homo sapiens
acgcgtccgcggacgcgtgggctgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 276299 - DNA, 324 bp, Homo sapiens
tcctttaaaattttgtctgcctttcatcttttagaccaacagtcttactttcatgtttaaaggcagtgaccataacagtcaagttaaacacaacaacttagattgcctaaatttgaatataggccttttttttttttttttttttttgggggggggggtttctttttgccccggggtgggggcgcaattttgggttaaagggaggttttgctttcgggtttaaggcctttttcaaattaatttaaatacttgggggatcttttagggtggccttgggggtttgcaattttggctttggccgttttttaacataaggaaacggct

SEQ ID NO: 276300 - DNA, 229 bp, Homo sapiens
catgattttaagccataccagaaaaaagagagccaacagatttctcaacaatccttaggcaaagaagccctccagtccactactggaaacatatttttgccatattttcctgccctttacttgaaaaattttaactggaaaagacacagtcactttgagtgttgaggtaatgctagaattcagccatgtgccacgatcacaaagtcatacaatattgccaaccttctac

SEQ ID NO: 276301 - DNA, 411 bp, Homo sapiens
taaaacgttagagattaaaaagtttataaagtaaaaaagttacagtaaggtaaggttaatttattgttgaagaaagaaacattttaacagtaaatttagtgtagcctgttgatgaagtcctcaatagcctacaggaatgccccgtggcttaccttttcatgctctttaaccctgtgtttcaaagagcagacgttttacattttgaacatgtccaatttgtcagtttgttcttttatagattgggattttagtgtcttatctaagaaaccattgcctcacctaaggtcacaaatattttctctcatgttttcttctagcagttttatagctttgggttttacatttaggtaaaaggtcccattttgagttagtttttgtatatggttcatgattatagattcaaattcttta

SEQ ID NO: 276302 - DNA, 1685 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngctgggactaagtgcctggagagcctcctgggctcagtgcccccgccctgccctggcctccacagccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggtctggaggtcactcactcaagtctgttgctggctgtgctgctccccaaggaagggcttccagacacagcagggtccagcccctggttggggaaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgagcttcctgtttgacaatgtttgctgttgattttttgttcaataaagaatttggt

SEQ ID NO: 276303 - DNA, 744 bp, Homo sapiens
atcagccagatgacaggaggccgaatgtatctcttctccaccttactggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgagcttcctgtttgacaatgtttgctgttgattttttgttcaataaagaatttggt

SEQ ID NO: 276304 - DNA, 973 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngctgggactaagtgcctggagagcctcctgggctcagtgcccccgccctgccctggcctccacagccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtggttaagttggagcctgacctggtgctgggcagagcccatgcctgggggtcccacgcctcgcctcaccagcagtgtggtcttgggcatgtcacctgactgctctgaggcccaccttgtttgtgataaaacggggacagcgatccttaacgcataggggaacatggggtgggacagtgctgctggcacaggcctgccagcgccttgtcactgtcggtcctcctccttttggcctcaccccaaggcccccacatgagtggtattaagtcccatcatcatagtcatccccaacctggcattctgcccagatctctgctgggaagcagcaggctgcgctgttccaggcagtgactttttcagatggaaggaacgaagacccactgtattcagtggattggtttagggatgctccaggcagggaaccacccggcaccctggcagtccatccagagggcctcctggaacttgtcctcagacctgggaagccaacgggagtgaca

SEQ ID NO: 276305 - DNA, 904 bp, Homo sapiens
gtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgagcttcctgtttgacaatgtttgctgttgattttttgttcaataaagaatttggt

SEQ ID NO: 276306 - DNA, 1994 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngctgggactaagtgcctggagagcctcctgggctcagtgcccccgccctgccctggcctccacagccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacaggtgtggggttgggagcagggaggtggataacccagcagggttgagggggaggccaccacctggtgcaacagacatagcactggcttttcctgtgtggccttgggcaagtcttccctcccttgggaacctcactttccccatctgtgcaatggaactaatcatcccagcctcctggcagccccctgcacaaggccaagcttgggccagtgttccagtccccacagtagggacacaggatctgctctgaaaagaaaggaggtgccggggaagtcctcatggcctgctctgtctggccctgtcttctgtccctccctctagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggtctggaggtcactcactcaagtctgttgctggctgtgctgctccccaaggaagggcttccagacacagcagggtccagcccctggttggggaaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgagcttcctgtttgacaatgtttgctgttgattttttgttcaataaagaatttggt

SEQ ID NO: 276307 - DNA, 1137 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngctgggactaagtgcctggagagcctcctgggctcagtgcccccgccctgccctggcctccacagccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccagccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgagcttcctgtttgacaatgtttgctgttgattttttgttcaataaagaatttggt

SEQ ID NO: 276308 - DNA, 383 bp, Homo sapiens
cctgacaaaaagatgagactaaataactgtgtcaggcattgtgttaacctaggaaataccacaggaatattttggtactctatctaacaggttcatactctaatggaggagataaagttaatagacaatgataattcagtgtgatgatggatgctacaaggacagggtgcctgagaaatatacaggggggattaatatggtttggctgtgttcctacccaaacctcatcttgaattgtagttcccacaattcccatgtgttatgagagagagccggtgggagataattgaaccattgggacagtttcccccatactgttctcatggtagtaagtctcagaagacctgatggttttttatacagggaaaccccttttgtttggt

SEQ ID NO: 276309 - DNA, 490 bp, Homo sapiens
ctgcatattctcttcagtggccatttctactcatccattgttttctttcagttatcccctcttcacccccacttaggaatcagagttggcttctagctgacatatccttggatactcacaagtgtgtgctagtctatattcctcagtaccacctgatccaggcttctctattaccaaattctgttcctgcatcagaataccttcattctacactgcactgaggccatgaggatttaatctgtttttgttgttgttgttgttgaacttatccagtatgctggagtgattttctgcccagtccttagttcttgagtcttgttcctttcgtagttggtcactccattatatcttgatctcagcatttcccagttggccaggttcaacttcctggttacctcttaagataaggttagaggacttgtacaccacctttactgctggaaaaaaagagtttgtaactagtttcatagtgtaaagctttctccgtatt

SEQ ID NO: 276310 - DNA, 451 bp, Homo sapiens
ctgaaacaagttagagaactttacacggaggatgtagattagtagattctcccacagttcacaacctatgcagagcagggtcctctctcctgccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataaaataacagggcggggcccatggatccctgtttgaatgagtctccgggcgccaaattagagaactaccgaaatattaatggaaggatggatggatgagtaggagcctggaactttctcaagacctgggatgtcaaatcccaaggagacctcacgtgtccagctgtggtgtggactgggggccgctccagccagctcactgccg

SEQ ID NO: 276311 - DNA, 431 bp, Homo sapiens
gtggtgccaaacccacatactctcctatcctcaatacctccctctactacccattattctgttctggatctcaaacatgctttctttactattcctttgcacccttcatcccagcctctctttgccttcacttagactgaccctgacacccattaggctcagcaaattacctgggctgtactgccgcaaggcttcacagacagcccccattacttcagtcaagcccaaatttcatcctcatctgttagtcatactcctattcaccgttctcaactactcatacatgccctgctcttgtttacactgccggtttacactgtttctccaagccatcacagctgatatcgcctggtgctatccccaaactgccactctaaactcttgaagtaaataaataatctttgctggcagaactatgctgaatctcctta

SEQ ID NO: 276312 - DNA, 616 bp, Homo sapiens
gagagtaagacagaagataggcacagagagagagagagacagacagagagacacagaaaaagaaagagaggggcagacagacagagaaagagacagatagagaaagagagaggcagacagagagagacagaaacagacagaaagagagagagagaaacagacagggagggagtgagagagagacagacggggagagaaagagagtaagatagaagacagacacagtgagacaggcagagagggagagagagggacaaagacagagacagaaagaaagaaagagacagacagacagacagagaaagagacacagagagaaagacagagatgaacagagagagacagagagaaacagacagagagaaggtcctagcccagtagcgatacagtgccttttctttcattttctctttcttttctttttgtctttcttttatgtatgtatgtatgtatgtatgtatgtatgtatgtatgtatgtatgtatttatctggagaccgggtctcactctgtcacccaggctgtagtgcagtggcacgatcttgggtcactgcaacctccgcctgccaggttcaagcaattcttccgcctcagcctcccgagtagctggggttaca

SEQ ID NO: 276313 - DNA, 380 bp, Homo sapiens
ttatatacattatgatggaatgctttcctagagtgatattctgtggtggaaagagcaaatcaaaggtctttgtgttctctgtgaccgtggaagaaattgccattaagtagtaatataaataggggttttaaaaaacgtgggaaaagtctgaagaagcatttgcagaaactccttacaaagtcagtgacagctaggccaggccaaggtgggcggatcacttaaggccaggagtttgagaccagcctggccaacatggcaaaaccctgtctctactaaaaatacaaaaattagctgagcgtgggtggctgagatgggagaattgcttgaacccaggaggcagaggttgcagtgagctgagatcgcaccactgcactccagtc

SEQ ID NO: 276314 - DNA, 303 bp, Homo sapiens
aaatagcagttcgagatgttaatcatagagttcccatatcacctagcaattttattcttaggtatgtgtccaaaagatgaaaaacacgtacatgaatgcttgttatagcattatcataatatccccaaagtggaaacaacccaaatgtccttgaatggaagaataggtagataaaatggggtatgtccatacagtagaatattattcagcaataaaaaggagtaaagtatttatacatgctacagcatggatgaatctcaaaaacatgctaagtgaagaagccagacatgaaagtccacatat

SEQ ID NO: 276315 - DNA, 441 bp, Homo sapiens
ggctgctccagacttcttggctcctgcaggccacctggacggatatgtgcaggtcacaggggttacaatggctaagcttcagctcacaggcctgacatttttgtctttttatttataaaatatgaagttgtaggaaaagattaaaaaaaagtgtaagttccttctggggattactggggtagggctgatatttctccggactgcttcaagtgtgaccagggactgcgtggacaccttaaagaaaattttataatgagtctaagtgagaacttgtgacggtgaataactcttctctttcctggtacctggacttcagagattaatacaaaaccctgtgggtcaggacttggcaacaccaagaagcattcaaatataatgatttattcaactgtgtattgtcatggaaataataattaaatggcacatctttgttgtctgaaa

SEQ ID NO: 276316 - DNA, 340 bp, Homo sapiens
tcagtaaccatgatcacgaccacatttgagaatcagggctctttgcagctggggcaatacttctggatcgggagcaacttatcatggaggacctggtattagaggacacgttgacaacatagaataatacagataaactcctacttctagaaaccaagaggagcaacaaagccaaaatatattagaggaatttgaagaggaagaactataaagtcaggagggggaaaattgccagaaacaatggctaaccagttgcctcagcatcatatatggagcagcccaccttttcatcagtctgagatgccacttttatcatataataaaggcctcatatatactt

SEQ ID NO: 276317 - DNA, 1214 bp, Homo sapiens
  misc_feature (1130)..(1130): n is a, c, g, or t
  misc_feature (1210)..(1210): n is a, c, g, or t
tcagtaaccatgatcacgaccacatttgagaatcagggctctttgcagctggggcaatacttctggatcgggagcaacttatcatggaggacctggtattagaggacacgttgacaacatagaataatacagataaactcctacttctagaaaccaagaggagcaacaaagccaaaatatattagaggaatttgaagaggaagaactataaagtcaggagggggaaaattgccagaaacagtaagttcctcttcaaagtttccttggtctttcttgctctatacgcagcccttcctgcttaatcaggaaggagcacttgtttctctgtttaatgggtaactagcaaacctcttacttggtaaacaacccttcccgcctagttggtaatggacagcctctcccttcctgcctaattggccttattcaatttcaagcactagtcaattgggtcagcttagactgtgctgtccaactccagcaaatggggaaaggacacagaaacagaaactgtgttagggataaaaacccctgctctacccggcttgatgtgctcttgggatcagtcagacgcaagctgtacccttctgcagaagtaaatgtgccttgctgagaaattctttgtttaagtggtggtttttctttgcagcactgaacacttgtttctaacacctggggggcagaggttgtggtgagccgagatcttgccattgccctccagcctggcgccatggctcacatgggaggctgagacaggcagatcacttgagcacagaagttcgagatcagcctgggcaacattggcaaaaccctgtctctacaaaaaatacaaaaactagctgggcatggtggttcaggcttgtcatcccagctacttgtgaggctgaggtgggaggataacttgagtccagtaggcagaggttacagtgagctgggatcatgccattgcattccagcctgggtgacagccagactctgtccccccccacaaaaaaagacagtcaacagaagattttaagcaaggaagcaactgctttgagatttgggggaaggtaaatctgggagtagatatcaagtgcatagggaaaggctaaagccaaggggaccagataaaagattattaaagatttctngagtgattatacctagtaatggagagggtttagacagatgaacattctcatgtccatcccatgtccatgtcatgtccatntcag

SEQ ID NO: 276318 - DNA, 158 bp, Homo sapiens
tgctcttggtgtttgaaagacccaaaggagaatcctcaaaagaaaatgttttggaagagctccaagaaacctccaaagaaatatagcaaattttgtttttttactgtttatttaacaacttggatttcacatttctttcttttttccctttttttttt

SEQ ID NO: 276319 - DNA, 893 bp, Homo sapiens
caccgcgtcgtcgtcggccgagacattgcgcacggtcaggcggcgctcggtgccctcctcctcgatgccgtacttggcgctcgcccacaaccgcgtctcctccttgaaccacgcggcctcagtggacggctggggcacctcacataggaacgtggccgactccttctcccgcacctccagatcttgcagccgctttttgaagggaaccgcgggctctgccaggagagaagactgctattttgaagcatacatgggaagctggttcctggacccccgcatataccaaaatctgtgcatactcaagttctacggtcagccctgtggaacccaagcataggacaagccggccctccctatacacacaggtttgacatcctgagaacactgctggttcccttcccatttggttccagaaaatctgcgtataagtggactcagtggtgcaaacctatgttgttcaagggtcaactatatatgatgaattattgttacctacagtcactctaccatgctactaaacactagaactgattcattttctctgactgtgtgtctctacccattaaccagcccctcttcatctcccttcccgcttccctccccagcctctggtaaccatcattcagttctctacctccgtgaaatcaacatgagtaagaactggtgaaacccaaacatagtctcgaatttagcttttttttttttttttaactgtaagaggctaaacattcttgaggaggacacaaaaaagtctgaagacaactgtccagatgagaatcttgcacttgcacaagtagagaggagagttagtttttataccatcgcatccccaatcccagctttattgatgcataacaaataaaaattgtacatatttaaagtgtacaatgtga

SEQ ID NO: 276320 - DNA, 569 bp, Homo sapiens
agctatacttgagtgctttgcccacacatggtgtaagtcataaaaagagcccagcaatatcttgtggtgtattctaaagggatgtctttgtgatcgctgttccctaagtcgccaggtgaccccattaagaaaatccacgtgagaaatttctttcaaactgactgccagtcaaagaaagacttgctatccccagggaatcaattaatatgacattttcacatgagaactgtacattttgtttctaagaccatgtgtgttcatttccactttgaccaacaggaaactcaaaggcaagctttcatgtctgctttaagaacaattgagagaggaccttggttctgcacatgcattccaatttgttgcaatctttaggtctgtccagacatttatctatttatggttctctatgtattttaaattttctcataagctatttctaatcctttcaggaatgaggcaaggtgtaaatcgataactctttcatgctgatagaatccacttaataccctagccggttaataataaaccactgaggtggcctgtgctcatctcagagtaactgtttcaga

SEQ ID NO: 276321 - DNA, 442 bp, Homo sapiens
cagtccccgccctccatctcacctcacccgtctcccaaccacccttttccatgttaccctcccttcctcacattgttacgggaatcttctgggatgaaaatgagtgtggttggcccttttgcgttgtttcagtcctctcggtacctccccgcccagccctgcgatcttaactcaccgggcccggctccccggccgcttgcataattagggagggcgagggcggggcgggaggcctgtggagaccaggcggaggctgcaatttttggtgccggccggcagagcaggttctggcggctgaggaaaatccggaccaataagttgattcaaacatcatcagttcctttcagaaatgttactagctcccagccttgccagcatctgcatagagagaatctcacatttattatatttgtgtcatctactaattttatgaactatagta

SEQ ID NO: 276322 - DNA, 694 bp, Homo sapiens
  misc_feature (12)..(12): n is a, c, g, or t
  misc_feature (29)..(29): n is a, c, g, or t
  misc_feature (71)..(71): n is a, c, g, or t
ctttacggctangtacgaggcgggtgtgnctcatctctcgctcctgggctcacatattcctccctcctggnctcctaaagtgttcagattacaggcgtgagccaccatgcctggcccttttcttatatttttaaatacatactactactcagaagctataaagaagtctggtaacaaatacatcaggagcacaagtggaggttgtggtgagccgagattgtgccactgcactccagcctgggcgacagagggagactctgcctcaaaaacaaaaaaacagaagaaatggtggcaggcgtggtggcatgtgcctgtactcccagctactcaggaagctgtggtgggaggatcgcttgagcccaggaggtcaaggctgtggtgagctgtgattgcaccaccacaagccagccagggcaacagagtgaaagcctgtctcaaaaacaaaacaaaacccaaaaaacaaattgacataagggctgcaaaaaacaaaaaaaaaaaaaaaaaaaaaaaaaaaactcccgggggtctctaattattcggggcggcgggaaaaaaaggtgtaatgaaaatgggaacatggtcattaggttgttctcttggacaagtttttttggtcaaggggggaaaatttggcaggttcccaataaggaggacgaataaatcgaaaagccaggtacctgtagagagtaaagaa

SEQ ID NO: 276323 - DNA, 893 bp, Homo sapiens
  misc_feature (12)..(12): n is a, c, g, or t
  misc_feature (29)..(29): n is a, c, g, or t
  misc_feature (71)..(71): n is a, c, g, or t
ctttacggctangtacgaggcgggtgtgnctcatctctcgctcctgggctcacatattcctccctcctggnctcctaaagtgttcagattacaggcgtgagccaccatgcctggcccttttcttatatttttaaatacatactactactcagaagctataaagaagtctggtaacaaatacatcaggagcacaagtggaggttgtggtgagccgagattgtgccactgcactccagcctgggcgacagagggagactctgcctcaaaaacaaaaaaacagaagaaatggtggcaggcgtggtggcatgtgcctgtactcccagctactcaggaagctgtggtgggaggatcgcttgagcccaggaggtcaaggctgtggtgagctgtgattgcaccaccacaagccagccagggcaacagagtgaaagcctgtctcaaaaacaaaacaaaacccaaaaaacaaattgacataagggctgcaaaaaacaaaacaggaaggataaataaatggggacaggagcagcatcgggggaggtgaccagtaagctaaggtctgtggatcatgcccttggccatataactatggacccacttcgccttttatgttcccccctggcccatttgtgacccttgaagagtcatgagaaataagcagaacttctagttaaaagataagacctgcacagtatttattaacaagcaagagtgtgaaaccccatctctactaaaaatacaaaaattacctgggtgtagtggcgcatgcctgtagtcccagctactcaggaggctgaggcaagagaatcgcttgaacctgggaggtggaggttgcagtgagctgagatcatgccactgcactccagactgggcaacagagcaagactctctttccagaa

SEQ ID NO: 276324 - DNA, 445 bp, Homo sapiens
cagcttgggcaacatgacacaacctggtctctacaaaaaatacaaaaattagctgggcatgggggcatgcacctgtagtcccagctattcaggaggctgaggtagaagaatctcttgagcctgggagattgaggctgcagtgagctatgatcagaccactgcactccagcctgggtaacagtgagatcctgtctctaaaaaataaattttaaaaaagtattattaggtcccacttttcaatttttggttttgttgcaattgctcgagggcttcatcataattatttcccagaagtcctttccaaaaacacaatatattgatcagaaataagaatcctctcatgagttgtaaccacttgcaaaatcaaaaccaaattggtaaaatgagtaaccaaattggtttactctttttttttgttttgtttttttgtttttttgaggtttgc

SEQ ID NO: 276325 - DNA, 5140 bp, Homo sapiens
  misc_feature (1757)..(1757): n is a, c, g, or t
  misc_feature (2029)..(2029): n is a, c, g, or t
  misc_feature (2031)..(2031): n is a, c, g, or t
  misc_feature (2034)..(2034): n is a, c, g, or t
  misc_feature (2246)..(2246): n is a, c, g, or t
  misc_feature (2992)..(2992): n is a, c, g, or t
  misc_feature (3597)..(3597): n is a, c, g, or t
  misc_feature (3803)..(3803): n is a, c, g, or t
gtccacaagtcctgggtctgggctctagccagatgggggtggagtggaggacacagggagtccctcatgcttgagtcccctggggccaccttgaggcagcctatcccaatgcatccccgccccactatccgggtggggcgcagaagagaggggagcccttctccgctcagtctccaggagactcagggcctgccagttctcaccagctgggaggtggacaaggtgatatggggagagatggaagaggaccgggaggagaggtggagagcggacagaggggctggctgttgagatgggtggacaggaggaaggacatctgggaggaccaggtctctccgctcctcttggcctcatgtgtctccgtcatgtgtggatgaggacatcagacctccctacctttccaggttttgtggggatcactgagatgaggcacgggaagccatcttgaattccctccccatcagtttgtgttctccctccttttctctcccggtaccttcctccttcccctccccttcgccccccttactttccccaatctctaataggacttcagtcagagctgcattgacaggcagccctaggcagccagataaggaacctcggcaaaaggtttttgagcatgaatgagcttaaagcttggcactagagcccagtgctggctgggttcgggcacgtgctggctaggacaggaagccaggcctggagcaagccctggtcaatggctacctggcctcaggaggtgaaggaccttgtcccaggctgggcagaggtcaggagactcagccccgagctagctggggacaagggctgccactgcacttagcactttcaggctccaaggcccagggcaggtgctgaggtgcctgtcttggagccgccatgcagccccgtccccacagctgtctaacggcagggggcagggaagttacaatcctaatcattcacattttctgacttggaggccctctcctaggtatcagcacatttactcctaactacacacagggaggagggaattattagcatcatccccactgcataaatgaggatcttgaggttaagcaactgcttagggtgcaatacacatggcagtgttcacaatcctttcagtggcctcatcagcagctctcaacaggcacgtttatagggaagaagtcaagagaaggggaagcctgaaagccacaggtgagactgggaaaggccaagagagggtcccagtcactcaaagggagccagaagtccaaggagggtcccccgaccccgacttgtacactggagaagggctgcccctacttcaaggccacagggcagctgcaggccacagtgtccacagcgtccttggtaaagtcgactatattcacatctgcattctgtgagtgcgggtataggtgggagtggaggagggaacttactttctgggtttacgggcacggtgtggtgtcagcccatttggaagcaaagcctagatatggagggggccagacgaacaggacctgggaatgcacaggaccccctgaagcaggccggggatctgagtgatcttgctgtatctaagctgacattggaacatgaacagtctgaaatcccatgagccccgctgccctgcacctgcgaccctcaggctagaccttggactgtctacaacacgagtcaggcccaacccgccctggaaatcatcgtaggaggttccagctcagtgcccagagacagcccccacatcccaccccatcaggtcagctcaggctggagcaggnatatgagcaacacccctcattccacccccatacacatgcataagcccatccgcctgcgccctgccagtctgaccagcacagtcctggggacaggagcgtggtggaggagctgcaggtgggggccagagaagcctccacagagagcaaaagcccagggtcagccagaagacaggacaccagaagaagacaggaagaatcaagaagaccagaggaacagagaagaggccccagagcaaggcaaggaacggccaaggcaccaggacatggatgcngnggngccagggggacgtggctgggccagcatgttggcgtgcaggctttggaaagccatcagcagggcgctgtttgcagagttcctggccacggggctgtatgtgttctttggcgtgggctcagtcatgcgctggcccacagcacttccctccgtgctacagattgccatcaccttcaacctggtcaccgccatggctgtgcaggtcacctggaagnccagcggggcccacgccaaccccgccgtgacgctggccttcctcgtaggctcccacatctctctgccccgtgctgtggcctatgtggctgcccagctggtgggggccacggtgggggctgctctgctttatggggtcatgccgggagacatccgagagacccttgggatcaacgtggctccacccacgtcctctgctctccgactgttcccaagttcttccctccacctcgaggcctgcctcactcgccccttctccatttcgtaaccatctgtgttccaccttcttcccccaaatctcctccttccacacctgctgccagtctcctctcaagcaagcctcctgaaccactggccccaaccaacccactggtggggtgggaggagcaccactcacttctgcagggagcaagggtccagagcagatatggacccctctgcacaggcctcccgaagtcctgaagctgggcggcagtgaggtgtcacccccttccagctgaggagaccaggcccagtggcaggggtttctctgtctgtccgtgggcagagcccgcgtctggtccagagtaactccctctgtccaggtccggaacagtgtctcaactggccaggcggtggcagtggagctgcttctgaccctgcagctggtgctctgtgtcttcgcttccaccgacagccgtcagacatcaggctccccggccaccatgattgggatctctgtggcactgggccacctcattgggatccncttcactggctgctccatgaatccagcccgctccttcggccctgccatcatcattgggaagttcacagtccactggctggaccaattttcaaacttggataaagaaaaagacaaacagaaatagacacacacaccagcagagacagaaacagcaatagccaggactcctggctaaaacgggggaagtgagaggaaagaggcgggggcgggtgaggagactggccccaggccccagccacggctgcagagcctgggctcagccccagggagggcagggagagcaaggggcaaggtccccttaccttgtgggcttgggaaacacgactcgtggttctcaaatttagcaccttacagacagttgagggagacctgggagatcaagtcggcactggggaagcaggcagcggtcccagagccaccctgtggtcctgatagctcctgggtggggtgacgacatccttctcctcaggtcttctgggtggggcccctgatgggagccctcctggcctcactgatctacaacttcgtcctgttccccgacaccaagaccctggcgcagcggctggctatcctcacaggcaccgtagaggtggggacaggggcangggcaggggcggagcccctgaagaaggaatcccagccgggttcgggagccgtggagatggagagtgtgtgaaacagcctacgcctggccgcgcccttgggcttcctgccttgcaggacctgcctggaggttctccctgggggtggcgggagggggaggcttgaccttttgtcctgaccaggtgggctggaggggacaagccctatncctggcattacgtttctaggtagaatctgggagtgaatttgtcccattccctctctgtagggcttccccacctctcggtgggacagagcagaggaaggcaggggatttaggatcgccctcccatcctctcacccactggaccccgtaggagtcctgaccccagatgcccaagtcttgggggagaaaggaatgggagcccagacagccactctgcttagacatgggagctatagggacctcagggagccccagcttcttacccacccaggaaacccttggtccagagaggacaggctttctggaggaatcaggccctgggacagcctctgagctcctgggggtgtttctctgaccttgggtgtggttttggggggtatatttcctccttcagactgggggcttcctgaggacagagactgctctaccaatagatctttgtttgttttgagacagaatcttgatctgttacccaggctggagtgcagtggcatgatctcggctcactgcaacctctacctcctgggttcaagggattctcctgcctcagcctcccaagtagctgggattacaggcgcctgccaccacgcccagctaattttttgtatttttagtagagatggggtttcatcatattggtcagggtggtctcaaactcctgacctgaggcgatctgcccacctcggcctcccaaagtgctgggattacaggcgtgagccaccgtgcccggcctctcccaataggtctttattcctcaatcctccaaatgctctggagaggcccccacccttgagaagaactgacacagagaagaacattttctcaggctcgtagagaggtgggatagaggaagggaggtttgagccagacaggcctttcccagggaagcctcctcccaggtgcttgccccagctcccaccccacagcccactctcaggcaggaacaatcctcagaggggaagtgcccatctagccattgactcatgacctgggtcaaagaagccgtctccaggctctctgtcagcattacaggatccccagaaagctgttgaataagccctaagggtggtaggaacccaggagggacccaggaaactaagatttgagattcagtgcctctgaaagactaccaaaatctaagttggtttaatagttaaaagctgctgtagatttattctgcccacaacttgggggtcctttctggatctcggcttctccagctgtaaaatggacacacaatcctcctccagggactgctgtgaaatcaagaaatcggaaaatactttcagaagttaaaatgctagaaaaacaaccccaataaatgatgattattgttgctg

SEQ ID NO: 276326 - DNA, 4341 bp, Homo sapiens
  misc_feature (1757)..(1757): n is a, c, g, or t
  misc_feature (2029)..(2029): n is a, c, g, or t
  misc_feature (2031)..(2031): n is a, c, g, or t
  misc_feature (2034)..(2034): n is a, c, g, or t
  misc_feature (2246)..(2246): n is a, c, g, or t
  misc_feature (2586)..(2586): n is a, c, g, or t
  misc_feature (2798)..(2798): n is a, c, g, or t
  misc_feature (3004)..(3004): n is a, c, g, or t
gtccacaagtcctgggtctgggctctagccagatgggggtggagtggaggacacagggagtccctcatgcttgagtcccctggggccaccttgaggcagcctatcccaatgcatccccgccccactatccgggtggggcgcagaagagaggggagcccttctccgctcagtctccaggagactcagggcctgccagttctcaccagctgggaggtggacaaggtgatatggggagagatggaagaggaccgggaggagaggtggagagcggacagaggggctggctgttgagatgggtggacaggaggaaggacatctgggaggaccaggtctctccgctcctcttggcctcatgtgtctccgtcatgtgtggatgaggacatcagacctccctacctttccaggttttgtggggatcactgagatgaggcacgggaagccatcttgaattccctccccatcagtttgtgttctccctccttttctctcccggtaccttcctccttcccctccccttcgccccccttactttccccaatctctaataggacttcagtcagagctgcattgacaggcagccctaggcagccagataaggaacctcggcaaaaggtttttgagcatgaatgagcttaaagcttggcactagagcccagtgctggctgggttcgggcacgtgctggctaggacaggaagccaggcctggagcaagccctggtcaatggctacctggcctcaggaggtgaaggaccttgtcccaggctgggcagaggtcaggagactcagccccgagctagctggggacaagggctgccactgcacttagcactttcaggctccaaggcccagggcaggtgctgaggtgcctgtcttggagccgccatgcagccccgtccccacagctgtctaacggcagggggcagggaagttacaatcctaatcattcacattttctgacttggaggccctctcctaggtatcagcacatttactcctaactacacacagggaggagggaattattagcatcatccccactgcataaatgaggatcttgaggttaagcaactgcttagggtgcaatacacatggcagtgttcacaatcctttcagtggcctcatcagcagctctcaacaggcacgtttatagggaagaagtcaagagaaggggaagcctgaaagccacaggtgagactgggaaaggccaagagagggtcccagtcactcaaagggagccagaagtccaaggagggtcccccgaccccgacttgtacactggagaagggctgcccctacttcaaggccacagggcagctgcaggccacagtgtccacagcgtccttggtaaagtcgactatattcacatctgcattctgtgagtgcgggtataggtgggagtggaggagggaacttactttctgggtttacgggcacggtgtggtgtcagcccatttggaagcaaagcctagatatggagggggccagacgaacaggacctgggaatgcacaggaccccctgaagcaggccggggatctgagtgatcttgctgtatctaagctgacattggaacatgaacagtctgaaatcccatgagccccgctgccctgcacctgcgaccctcaggctagaccttggactgtctacaacacgagtcaggcccaacccgccctggaaatcatcgtaggaggttccagctcagtgcccagagacagcccccacatcccaccccatcaggtcagctcaggctggagcaggnatatgagcaacacccctcattccacccccatacacatgcataagcccatccgcctgcgccctgccagtctgaccagcacagtcctggggacaggagcgtggtggaggagctgcaggtgggggccagagaagcctccacagagagcaaaagcccagggtcagccagaagacaggacaccagaagaagacaggaagaatcaagaagaccagaggaacagagaagaggccccagagcaaggcaaggaacggccaaggcaccaggacatggatgcngnggngccagggggacgtggctgggccagcatgttggcgtgcaggctttggaaagccatcagcagggcgctgtttgcagagttcctggccacggggctgtatgtgttctttggcgtgggctcagtcatgcgctggcccacagcacttccctccgtgctacagattgccatcaccttcaacctggtcaccgccatggctgtgcaggtcacctggaagnccagcggggcccacgccaaccccgccgtgacgctggccttcctcgtaggctcccacatctctctgccccgtgctgtggcctatgtggctgcccagctggtgggggccacggtgggggctgctctgctttatggggtcatgccgggagacatccgagagacccttgggatcaacgtggtccggaacagtgtctcaactggccaggcggtggcagtggagctgcttctgaccctgcagctggtgctctgtgtcttcgcttccaccgacagccgtcagacatcaggctccccggccaccatgattgggatctctgtggcactgggccacctcattgggatccncttcactggctgctccatgaatccagcccgctccttcggccctgccatcatcattgggaagttcacagtccactgggtcttctgggtggggcccctgatgggagccctcctggcctcactgatctacaacttcgtcctgttccccgacaccaagaccctggcgcagcggctggctatcctcacaggcaccgtagaggtggggacaggggcangggcaggggcggagcccctgaagaaggaatcccagccgggttcgggagccgtggagatggagagtgtgtgaaacagcctacgcctggccgcgcccttgggcttcctgccttgcaggacctgcctggaggttctccctgggggtggcgggagggggaggcttgaccttttgtcctgaccaggtgggctggaggggacaagccctatncctggcattacgtttctaggtagaatctgggagtgaatttgtcccattccctctctgtagggcttccccacctctcggtgggacagagcagaggaaggcaggggatttaggatcgccctcccatcctctcacccactggaccccgtaggagtcctgaccccagatgcccaagtcttgggggagaaaggaatgggagcccagacagccactctgcttagacatgggagctatagggacctcagggagccccagcttcttacccacccaggaaacccttggtccagagaggacaggctttctggaggaatcaggccctgggacagcctctgagctcctgggggtgtttctctgaccttgggtgtggttttggggggtatatttcctccttcagactgggggcttcctgaggacagagactgctctaccaatagatctttgtttgttttgagacagaatcttgatctgttacccaggctggagtgcagtggcatgatctcggctcactgcaacctctacctcctgggttcaagggattctcctgcctcagcctcccaagtagctgggattacaggcgcctgccaccacgcccagctaattttttgtatttttagtagagatggggtttcatcatattggtcagggtggtctcaaactcctgacctgaggcgatctgcccacctcggcctcccaaagtgctgggattacaggcgtgagccaccgtgcccggcctctcccaataggtctttattcctcaatcctccaaatgctctggagaggcccccacccttgagaagaactgacacagagaagaacattttctcaggctcgtagagaggtgggatagaggaagggaggtttgagccagacaggcctttcccagggaagcctcctcccaggtgcttgccccagctcccaccccacagcccactctcaggcaggaacaatcctcagaggggaagtgcccatctagccattgactcatgacctgggtcaaagaagccgtctccaggctctctgtcagcattacaggatccccagaaagctgttgaataagccctaagggtggtaggaacccaggagggacccaggaaactaagatttgagattcagtgcctctgaaagactaccaaaatctaagttggtttaatagttaaaagctgctgtagatttattctgcccacaacttgggggtcctttctggatctcggcttctccagctgtaaaatggacacacaatcctcctccagggactgctgtgaaatcaagaaatcggaaaatactttcagaagttaaaatgctagaaaaacaaccccaataaatgatgattattgttgctg

SEQ ID NO: 276327 - DNA, 3067 bp, Homo sapiens
  misc_feature (1757)..(1757): n is a, c, g, or t
  misc_feature (2029)..(2029): n is a, c, g, or t
  misc_feature (2031)..(2031): n is a, c, g, or t
  misc_feature (2034)..(2034): n is a, c, g, or t
  misc_feature (2246)..(2246): n is a, c, g, or t
gtccacaagtcctgggtctgggctctagccagatgggggtggagtggaggacacagggagtccctcatgcttgagtcccctggggccaccttgaggcagcctatcccaatgcatccccgccccactatccgggtggggcgcagaagagaggggagcccttctccgctcagtctccaggagactcagggcctgccagttctcaccagctgggaggtggacaaggtgatatggggagagatggaagaggaccgggaggagaggtggagagcggacagaggggctggctgttgagatgggtggacaggaggaaggacatctgggaggaccaggtctctccgctcctcttggcctcatgtgtctccgtcatgtgtggatgaggacatcagacctccctacctttccaggttttgtggggatcactgagatgaggcacgggaagccatcttgaattccctccccatcagtttgtgttctccctccttttctctcccggtaccttcctccttcccctccccttcgccccccttactttccccaatctctaataggacttcagtcagagctgcattgacaggcagccctaggcagccagataaggaacctcggcaaaaggtttttgagcatgaatgagcttaaagcttggcactagagcccagtgctggctgggttcgggcacgtgctggctaggacaggaagccaggcctggagcaagccctggtcaatggctacctggcctcaggaggtgaaggaccttgtcccaggctgggcagaggtcaggagactcagccccgagctagctggggacaagggctgccactgcacttagcactttcaggctccaaggcccagggcaggtgctgaggtgcctgtcttggagccgccatgcagccccgtccccacagctgtctaacggcagggggcagggaagttacaatcctaatcattcacattttctgacttggaggccctctcctaggtatcagcacatttactcctaactacacacagggaggagggaattattagcatcatccccactgcataaatgaggatcttgaggttaagcaactgcttagggtgcaatacacatggcagtgttcacaatcctttcagtggcctcatcagcagctctcaacaggcacgtttatagggaagaagtcaagagaaggggaagcctgaaagccacaggtgagactgggaaaggccaagagagggtcccagtcactcaaagggagccagaagtccaaggagggtcccccgaccccgacttgtacactggagaagggctgcccctacttcaaggccacagggcagctgcaggccacagtgtccacagcgtccttggtaaagtcgactatattcacatctgcattctgtgagtgcgggtataggtgggagtggaggagggaacttactttctgggtttacgggcacggtgtggtgtcagcccatttggaagcaaagcctagatatggagggggccagacgaacaggacctgggaatgcacaggaccccctgaagcaggccggggatctgagtgatcttgctgtatctaagctgacattggaacatgaacagtctgaaatcccatgagccccgctgccctgcacctgcgaccctcaggctagaccttggactgtctacaacacgagtcaggcccaacccgccctggaaatcatcgtaggaggttccagctcagtgcccagagacagcccccacatcccaccccatcaggtcagctcaggctggagcaggnatatgagcaacacccctcattccacccccatacacatgcataagcccatccgcctgcgccctgccagtctgaccagcacagtcctggggacaggagcgtggtggaggagctgcaggtgggggccagagaagcctccacagagagcaaaagcccagggtcagccagaagacaggacaccagaagaagacaggaagaatcaagaagaccagaggaacagagaagaggccccagagcaaggcaaggaacggccaaggcaccaggacatggatgcngnggngccagggggacgtggctgggccagcatgttggcgtgcaggctttggaaagccatcagcagggcgctgtttgcagagttcctggccacggggctgtatgtgttctttggcgtgggctcagtcatgcgctggcccacagcacttccctccgtgctacagattgccatcaccttcaacctggtcaccgccatggctgtgcaggtcacctggaagnccagcggggcccacgccaaccccgccgtgacgctggccttcctcgtaggctcccacatctctctgccccgtgctgtggcctatgtggctgcccagctggtgggggccacggtgggggctgctctgctttatggggtcatgccgggagacatccgagagacccttgggatcaacgtggctccacccacgtcctctgctctccgactgttcccaagttcttccctccacctcgaggcctgcctcactcgccccttctccatttcgtaaccatctgtgttccaccttcttcccccaaatctcctccttccacacctgctgccagtctcctctcaagcaagcctcctgaaccactggccccaaccaacccactggtggggtgggaggagcaccactcacttctgcagggagcaagggtccagagcagatatggacccctctgcacaggcctcccgaagtcctgaagctgggcggcagtgaggtgtcacccccttccagctgaggagaccaggcccagtggcaggggtttctctgtctgtccgtgggcagagcccgcgtctggtccagagtaactccctctgtccaggtccggaacagtgtctcaactggccaggcggtggcagtggagctgcttctgaccctgcagctggtgctctgtgtcttcgcttccaccgacagccgtcagacatcaggctccccggccaccatgattgggatctctgtggcactgggccacctcattgggctgtctctccaggaggacacaaagaaaagatcaagacaggatgtgccaaatgtagcaaggaggcatacaataatctgcaa

SEQ ID NO: 276328 - DNA, 444 bp, Homo sapiens
taaattcatactgtgaggaaaagcaaaagataggaggtgaggcaaaagctactctttaactgtgagttttttttccttgcgatggggtttggctgcctagtctagattctcacgctagccccactttcgtctgctctgtggcatatttttaacctgagttgcaggacaggtggtttccagagtgttgcctgatgcatcccaaatgctgccttagcaatacacatctgaacaggggcccatcactaatagcaagcatttcattaatctgagcaaaactcatgggttttcacagggaccctaccagctcagaagcacgttgatataaataagtagaaaaccaaagacagctaaattttaaatcttgagtcaaaactttaaaatcaaagtcaaattgatttcattttggtgagctttcaaatcatgcttttaaaaataaattatgta

SEQ ID NO: 276329 - DNA, 530 bp, Homo sapiens
tggtagaatactgaagtagaaaacagaccactaaacaatgatcttgcagtatcaaacattttctcaaaaaattatgacataggatcaaaaaaacagaatgctaggcacccaagataaaaagcacaaaatgtaagagaatagatcacctgttcaaagaaccaaagctcacaataacgtatgacagaacacctatacattaaaaaaaaaaagaaagaaatgccgataacagaattgaaaaaaacaaaatgaggtcggatgcagtggctcacgcctgtaatcccagtatttagagaggccaaggtgggtggatcacctgaggtcaggagttcgagactgcctggcctatgtggtgagactccatctctactaaaaacacaaaaattagctgggcatggtggcaggcacctataatcccagctatatgggaggctggggcaggagaatcgcttgaacccgggaggcagaggttgcagtgagctgagattgcgccattgcactccagcctgggtgacaagagccaaactccatct

SEQ ID NO: 276330 - DNA, 433 bp, Homo sapiens
gacacctcaggtccaggagctgaagtgagcatcactcagttgacagaaagcatctagaatgtgtcagcgaaaggcactggaattatcattccttcttgagaaggaaagaagaagaaagaagaaggaggaggaggagcaggaggaagaggagcaggaggagcaggacaaggaggaggaagtcttcttcccttgaggaattcttagtctcctgggaaagatagctctttatactgataatatgccacattttcttatgggtcttgatggacatgcacaaagtttaaaaatatcacaaaaaggagagatgattgagagtagctgatagagggtgaaagcagactttacagggtactggatgccgtaatagagctgtgagcactaaactggaatgtgccaaacacaagagagaatcgtggtgcccttcctggtagag

SEQ ID NO: 276331 - DNA, 418 bp, Homo sapiens
agaactgaagcaaatttgctaattttgtagtattctgtaaagcagcaaactgtgatattcagtgaagttctcactgcaaattgggaaccgagaaaggatataacacatcctttgcactcctatagaacctatcaaggctaaagatgttgagcctgactctcttaacagctccagtgtctgaaataaatattctaatgtctaaatgaaattgtgctcattccctcagggtttagtgtaaaacaatatgctcttgaggtgaggacaagaaggccgtcacctgagcatgtgagttttcatgttgatactctgaacattccattctagactacctggaatcaaggaccacatctgagtgtgttatacttgcaaacagtttggcttattatcattgcaattggaaatcttacaagcatatata

SEQ ID NO: 276332 - DNA, 404 bp, Homo sapiens
aaaaatacattggttaaagtaattattacaactttacattttaagtttgacctttatgaatctctttctacctgcaaatcattgagatttgtgtttttccacacagtattctccatttcatcaggagtattagagttgaagcatttcttaaaagagtgattttaggcaagtgggttgcctgacctcaggagtttgagaccagcctgggcaacatggtgaaatcctgtctctactaaaatacaaaaaattagccaggcgtggtgacatgcacctgtagtcccagctactcgggaggctgaggcaggagaattgcttgaagctgggaaggggaagttgcagtgagccaagatggcgccactgcactccagcctgggagacagagtgagactctgtctcaaaaaaaa

SEQ ID NO: 276333 - DNA, 4220 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccactctattctcagctagctaatgctgatttcctcacctttgcctctttccatacattgagctactgaagcatagatgaagcactggaagcaagtttttccagaatgctcttcacttcctagtatcctactctatatttgctaacacctaactacactgccttttacttaatctgtgatttcttctctcaatattttactagcaagaggagaggatgttcctcacccttgaggggatattgagttaaacccctagcctgcctcccctcttaattgctgcagggatagagaatggaacagttggccaaggctgcagctagttttgatcactgaaactggcttcctactccagcatgtttttcaaattacgtggctggtggtgcttctacctttaaaagtgggtgtgtgtcactctggctgattgctggacagaggtccagctttctctttttcgcttgttcaaccaaggcccattttatctgaggcttaaatgtacctgcctatctgtgtggctagtcctaggtaggttcgtctggtttgggttgctatggctgatagactccaccaggcagcaccaaagccggtaaactaacctctgctaatatctgtctttctcaatagccattcatgctttatcttttgctgctctaccatgtgctccagcatgagatcaaatcaccagcaggttacaaggcctcagcccagggattggtagatatatgttctggcccattgttttataaagggctcaagagaccaaagcttgttgcctacttaccttgacaactctaaagtagctctgtgaagtagagtcatgcctcgcttaatgacagggatatgttctgagaatgtggggcaatttcattgtgcacatatcagagtgtacttaacagtcctagacagaacagcctacacacctaaactatatggtatggcgttttcctcctaggctacaaacctgggcagcatgttacaggaaagaatactgtaggcaattgtgggttttttttgattcaggctattcctgggatactgtaggcaattgtaacgcaatggtaagtatttgtgtatctaaacatagaaaaggtacagtaaaaatatggtataatcttatgggaccaccatagtgtatgtggcctgtcgttaactgaaacatcattatgcagtgcatgactgtatgaaggatttctcttctgtgaggtgtaacagaatggactggctgaggaaaaaggggtcacgggcatgcgtgcacatgcactctgtctgtgactaatagaatggtgctcagagttcctcaccttttactcctaacgcagcctattgcaggctagggatctcagagaaactaccttcaagggaccttttgctgacacttaaccaaacttagaagggtgggccatgtgtaagagaggcagtatggccactgatgttatttatttttcaacacgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276334 - DNA, 2839 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276335 - DNA, 2718 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276336 - DNA, 4685 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcaggtactgtcttctcaaattatgccctaggatctccgtagtatatagcagtttgaacaaaactgacagctgtttcttcagtcttaaataaggagacaatgtaaggtaagagaatgagggaagctaaggatagtaatatatgatatacaaccttgatttttgtttaacagttaaaaaacctttatatggctccaagaaaatgaaattatagatgaaataatattagtcatttgaattagactagtgtttaattaaaatttttttcagttctaaatttgaatgctaattcttggggtctgagatcccgacagccttacagctcgtgtttaggaggcatgaaaacatgctactttgaactctcatgaaagtgcctcctcctctactccagacatttctttgcgggaggctagagggctagcctctgtgctgctgctttgccgtgagtgacactggctttctatgctgtagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccactctattctcagctagctaatgctgatttcctcacctttgcctctttccatacattgagctactgaagcatagatgaagcactggaagcaagtttttccagaatgctcttcacttcctagtatcctactctatatttgctaacacctaactacactgccttttacttaatctgtgatttcttctctcaatattttactagcaagaggagaggatgttcctcacccttgaggggatattgagttaaacccctagcctgcctcccctcttaattgctgcagggatagagaatggaacagttggccaaggctgcagctagttttgatcactgaaactggcttcctactccagcatgtttttcaaattacgtggctggtggtgcttctacctttaaaagtgggtgtgtgtcactctggctgattgctggacagaggtccagctttctctttttcgcttgttcaaccaaggcccattttatctgaggcttaaatgtacctgcctatctgtgtggctagtcctaggtaggttcgtctggtttgggttgctatggctgatagactccaccaggcagcaccaaagccggtaaactaacctctgctaatatctgtctttctcaatagccattcatgctttatcttttgctgctctaccatgtgctccagcatgagatcaaatcaccagcaggttacaaggcctcagcccagggattggtagatatatgttctggcccattgttttataaagggctcaagagaccaaagcttgttgcctacttaccttgacaactctaaagtagctctgtgaagtagagtcatgcctcgcttaatgacagggatatgttctgagaatgtggggcaatttcattgtgcacatatcagagtgtacttaacagtcctagacagaacagcctacacacctaaactatatggtatggcgttttcctcctaggctacaaacctgggcagcatgttacaggaaagaatactgtaggcaattgtgggttttttttgattcaggctattcctgggatactgtaggcaattgtaacgcaatggtaagtatttgtgtatctaaacatagaaaaggtacagtaaaaatatggtataatcttatgggaccaccatagtgtatgtggcctgtcgttaactgaaacatcattatgcagtgcatgactgtatgaaggatttctcttctgtgaggtgtaacagaatggactggctgaggaaaaaggggtcacgggcatgcgtgcacatgcactctgtctgtgactaatagaatggtgctcagagttcctcaccttttactcctaacgcagcctattgcaggctagggatctcagagaaactaccttcaagggaccttttgctgacacttaaccaaacttagaagggtgggccatgtgtaagagaggcagtatggccactgatgttatttatttttcaacacgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276337 - DNA, 2760 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276338 - DNA, 2784 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276339 - DNA, 2290 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276340 - DNA, 2169 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276341 - DNA, 1276 bp, Homo sapiens
tcgtacatggtcttctgttcatggtcttctcgtaatggtcggaagaaaacaccccgtactggcaggcatggagccaacaaggagaacctggagctcaacggcagcatcctgagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276342 - DNA, 4248 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccactctattctcagctagctaatgctgatttcctcacctttgcctctttccatacattgagctactgaagcatagatgaagcactggaagcaagtttttccagaatgctcttcacttcctagtatcctactctatatttgctaacacctaactacactgccttttacttaatctgtgatttcttctctcaatattttactagcaagaggagaggatgttcctcacccttgaggggatattgagttaaacccctagcctgcctcccctcttaattgctgcagggatagagaatggaacagttggccaaggctgcagctagttttgatcactgaaactggcttcctactccagcatgtttttcaaattacgtggctggtggtgcttctacctttaaaagtgggtgtgtgtcactctggctgattgctggacagaggtccagctttctctttttcgcttgttcaaccaaggcccattttatctgaggcttaaatgtacctgcctatctgtgtggctagtcctaggtaggttcgtctggtttgggttgctatggctgatagactccaccaggcagcaccaaagccggtaaactaacctctgctaatatctgtctttctcaatagccattcatgctttatcttttgctgctctaccatgtgctccagcatgagatcaaatcaccagcaggttacaaggcctcagcccagggattggtagatatatgttctggcccattgttttataaagggctcaagagaccaaagcttgttgcctacttaccttgacaactctaaagtagctctgtgaagtagagtcatgcctcgcttaatgacagggatatgttctgagaatgtggggcaatttcattgtgcacatatcagagtgtacttaacagtcctagacagaacagcctacacacctaaactatatggtatggcgttttcctcctaggctacaaacctgggcagcatgttacaggaaagaatactgtaggcaattgtgggttttttttgattcaggctattcctgggatactgtaggcaattgtaacgcaatggtaagtatttgtgtatctaaacatagaaaaggtacagtaaaaatatggtataatcttatgggaccaccatagtgtatgtggcctgtcgttaactgaaacatcattatgcagtgcatgactgtatgaaggatttctcttctgtgaggtgtaacagaatggactggctgaggaaaaaggggtcacgggcatgcgtgcacatgcactctgtctgtgactaatagaatggtgctcagagttcctcaccttttactcctaacgcagcctattgcaggctagggatctcagagaaactaccttcaagggaccttttgctgacacttaaccaaacttagaagggtgggccatgtgtaagagaggcagtatggccactgatgttatttatttttcaacacgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaaaaaaaaaccacaaaaaagggcggccgct

SEQ ID NO: 276343 - DNA, 4221 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccactctattctcagctagctaatgctgatttcctcacctttgcctctttccatacattgagctactgaagcatagatgaagcactggaagcaagtttttccagaatgctcttcacttcctagtatcctactctatatttgctaacacctaactacactgccttttacttaatctgtgatttcttctctcaatattttactagcaagaggagaggatgttcctcacccttgaggggatattgagttaaacccctagcctgcctcccctcttaattgctgcagggatagagaatggaacagttggccaaggctgcagctagttttgatcactgaaactggcttcctactccagcatgtttttcaaattacgtggctggtggtgcttctacctttaaaagtgggtgtgtgtcactctggctgattgctggacagaggtccagctttctctttttcgcttgttcaaccaaggcccattttatctgaggcttaaatgtacctgcctatctgtgtggctagtcctaggtaggttcgtctggtttgggttgctatggctgatagactccaccaggcagcaccaaagccggtaaactaacctctgctaatatctgtctttctcaatagccattcatgctttatcttttgctgctctaccatgtgctccagcatgagatcaaatcaccagcaggttacaaggcctcagcccagggattggtagatatatgttctggcccattgttttataaagggctcaagagaccaaagcttgttgcctacttaccttgacaactctaaagtagctctgtgaagtagagtcatgcctcgcttaatgacagggatatgttctgagaatgtggggcaatttcattgtgcacatatcagagtgtacttaacagtcctagacagaacagcctacacacctaaactatatggtatggcgttttcctcctaggctacaaacctgggcagcatgttacaggaaagaatactgtaggcaattgtgggttttttttgattcaggctattcctgggatactgtaggcaattgtaacgcaatggtaagtatttgtgtatctaaacatagaaaaggtacagtaaaaatatggtataatcttatgggaccaccatagtgtatgtggcctgtcgttaactgaaacatcattatgcagtgcatgactgtatgaaggatttctcttctgtgaggtgtaacagaatggactggctgaggaaaaaggggtcacgggcatgcgtgcacatgcactctgtctgtgactaatagaatggtgctcagagttcctcaccttttactcctaacgcagcctattgcaggctagggatctcagagaaactaccttcaagggaccttttgctgacacttaaccaaacttagaagggtgggccatgtgtaagagaggcagtatggccactgatgttatttatttttcaacacgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgggcccggcttaaatttccattttcttacataataacctgttcctctcttctcaaaaaaaacccgggcttt

SEQ ID NO: 276344 - DNA, 2012 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccactctattctcagctagctaatgctgatttcctcacctttgcctctttccatacattgagctactgaagcatagatgaagcactggaagcaagtttttccagaatgctcttcacttcctagtatcctactctatatttgctaacacctaactacactgccttttacttaatctgtgatttctttctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276345 - DNA, 1816 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagcgagaactttcaaaggcttccaaatctgatgctacttctggaatctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276346 - DNA, 988 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtt

SEQ ID NO: 276347 - DNA, 293 bp, Homo sapiens
aggaacattcaaaggcatttatggtgaatgggcagaaattcatggagtatgtggcagaacaatgggagatgcatcgattggagaaagagagagccaagcaggaaagagtaagtgtgaacgtgaacgcaaattgggaaaagacgaagaaagtaatctgagcagcccatagtctctgccggggaccagggtttgtggaacagggagccggggaccggggcttgtggaacgggaagccggggaccggggcttgtggaacggggagccggggaccggggcttgtggaacggggagcc

SEQ ID NO: 276348 - DNA, 496 bp, Homo sapiens
aaatgtatttttcacagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaaggtaaacacaaggcttagggaaacactgatttcaagggagtgggtgagggtagtcccagccacctctttgaagggggccagcccctccacacctgtgggtatttctcatcaggtgggacaagagac

SEQ ID NO: 276349 - DNA, 2797 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276350 - DNA, 4148 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcaggtggtgggtaccctggctcggcccccctccagcgcaacttcagcattaattctgttgccactctattctcagctagctaatgctgatttcctcacctttgcctctttccatacattgagctactgaagcatagatgaagcactggaagcaagtttttccagaatgctcttcacttcctagtatcctactctatatttgctaacacctaactacactgccttttacttaatctgtgatttcttctctcaatattttactagcaagaggagaggatgttcctcacccttgaggggatattgagttaaacccctagcctgcctcccctcttaattgctgcagggatagagaatggaacagttggccaaggctgcagctagttttgatcactgaaactggcttcctactccagcatgtttttcaaattacgtggctggtggtgcttctacctttaaaagtgggtgtgtgtcactctggctgattgctggacagaggtccagctttctctttttcgcttgttcaaccaaggcccattttatctgaggcttaaatgtacctgcctatctgtgtggctagtcctaggtaggttcgtctggtttgggttgctatggctgatagactccaccaggcagcaccaaagccggtaaactaacctctgctaatatctgtctttctcaatagccattcatgctttatcttttgctgctctaccatgtgctccagcatgagatcaaatcaccagcaggttacaaggcctcagcccagggattggtagatatatgttctggcccattgttttataaagggctcaagagaccaaagcttgttgcctacttaccttgacaactctaaagtagctctgtgaagtagagtcatgcctcgcttaatgacagggatatgttctgagaatgtggggcaatttcattgtgcacatatcagagtgtacttaacagtcctagacagaacagcctacacacctaaactatatggtatggcgttttcctcctaggctacaaacctgggcagcatgttacaggaaagaatactgtaggcaattgtgggttttttttgattcaggctattcctgggatactgtaggcaattgtaacgcaatggtaagtatttgtgtatctaaacatagaaaaggtacagtaaaaatatggtataatcttatgggaccaccatagtgtatgtggcctgtcgttaactgaaacatcattatgcagtgcatgactgtatgaaggatttctcttctgtgaggtgtaacagaatggactggctgaggaaaaaggggtcacgggcatgcgtgcacatgcactctgtctgtgactaatagaatggtgctcagagttcctcaccttttactcctaacgcagcctattgcaggctagggatctcagagaaactaccttcaagggaccttttgctgacacttaaccaaacttagaagggtgggccatgtgtaagagaggcagtatggccactgatgttatttatttttcaacacgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276351 - DNA, 4555 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccactctattctcagctagctaatgctgatttcctcacctttgcctctttccatacattgagctactgaagcatagatgaagcactggaagcaagtttttccagaatgctcttcacttcctagtatcctactctatatttgctaacacctaactacactgccttttacttaatctgtgatttcttctctcaatattttactagcaagaggagaggatgttcctcacccttgaggggatattgagttaaacccctagcctgcctcccctcttaattgctgcagggatagagaatggaacagttggccaaggctgcagctagttttgatcactgaaactggcttcctactccagcatgtttttcaaattacgtggctggtggtgcttctacctttaaaagtgggtgtgtgtcactctggctgattgctggacagaggtccagctttctctttttcgcttgttcaaccaaggcccattttatctgaggcttaaatgtacctgcctatctgtgtggctagtcctaggtaggttcgtctggtttgggttgctatggctgatagactccaccaggcagcaccaaagccggtaaactaacctctgctaatatctgtctttctcaatagccattcatgctttatcttttgctgctctaccatgtgctccagcatgagatcaaatcaccagcaggttacaaggcctcagcccagggattggtagatatatgttctggcccattgttttataaagggctcaagagaccaaagcttgttgcctacttaccttgacaactctaaagtagctctgtgaagtagagtcatgcctcgcttaatgacagggatatgttctgagaatgtggggcaatttcattgtgcacatatcagagtgtacttaacagtcctagacagaacagcctacacacctaaactatatggtatggcgttttcctcctaggctacaaacctgggcagcatgttacaggaaagaatactgtaggcaattgtgggttttttttgattcaggctattcctgggatactgtaggcaattgtaacgcaatggtaagtatttgtgtatctaaacatagaaaaggtacagtaaaaatatggtataatcttatgggaccaccatagtgtatgtggcctgtcgttaactgaaacatcattatgcagtgcatgactgtatgaaggatttctcttctgtgaggtgtaacagaatggactggctgaggaaaaaggggtcacgggcatgcgtgcacatgcactctgtctgtgactaatagaatggtgctcagagttcctcaccttttactcctaacgcagcctattgcaggctagggatctcagagaaactaccttcaagggaccttttgctgacacttaaccaaacttagaagggtgggccatgtgtaagagaggcagtatggccactgatgttatttatttttcaacacgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaaaaaaaaaaaacgaaaatgtaaaaaaaaaaagggggggggggtgataaaatactccctcgggggcaccaaaggtaacgcgtgaccgcggtttttttgtacaagggggggcccaaataggggggcgggaataaaaacgaaaggacagggagggggtaacaaacggcggtgggggaaaaatggtacgtgtggacttggggaagggaccctacttgtgggcgggcgcattgcggaccacaccaaaagggattagcgcctagggacataacatctacgtgtgttggcacacgcgatttcgtggtaagtggtcgggtgatgatgtggcggtagcactttcg

SEQ ID NO: 276352 - DNA, 4201 bp, Homo sapiens
  misc_feature (4169)..(4169): n is a, c, g, or t
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccactctattctcagctagctaatgctgatttcctcacctttgcctctttccatacattgagctactgaagcatagatgaagcactggaagcaagtttttccagaatgctcttcacttcctagtatcctactctatatttgctaacacctaactacactgccttttacttaatctgtgatttcttctctcaatattttactagcaagaggagaggatgttcctcacccttgaggggatattgagttaaacccctagcctgcctcccctcttaattgctgcagggatagagaatggaacagttggccaaggctgcagctagttttgatcactgaaactggcttcctactccagcatgtttttcaaattacgtggctggtggtgcttctacctttaaaagtgggtgtgtgtcactctggctgattgctggacagaggtccagctttctctttttcgcttgttcaaccaaggcccattttatctgaggcttaaatgtacctgcctatctgtgtggctagtcctaggtaggttcgtctggtttgggttgctatggctgatagactccaccaggcagcaccaaagccggtaaactaacctctgctaatatctgtctttctcaatagccattcatgctttatcttttgctgctctaccatgtgctccagcatgagatcaaatcaccagcaggttacaaggcctcagcccagggattggtagatatatgttctggcccattgttttataaagggctcaagagaccaaagcttgttgcctacttaccttgacaactctaaagtagctctgtgaagtagagtcatgcctcgcttaatgacagggatatgttctgagaatgtggggcaatttcattgtgcacatatcagagtgtacttaacagtcctagacagaacagcctacacacctaaactatatggtatggcgttttcctcctaggctacaaacctgggcagcatgttacaggaaagaatactgtaggcaattgtgggttttttttgattcaggctattcctgggatactgtaggcaattgtaacgcaatggtaagtatttgtgtatctaaacatagaaaaggtacagtaaaaatatggtataatcttatgggaccaccatagtgtatgtggcctgtcgttaactgaaacatcattatgcagtgcatgactgtatgaaggatttctcttctgtgaggtgtaacagaatggactggctgaggaaaaaggggtcacgggcatgcgtgcacatgcactctgtctgtgactaatagaatggtgctcagagttcctcaccttttactcctaacgcagcctattgcaggctagggatctcagagaaactaccttcaagggaccttttgctgacacttaaccaaacttagaagggtgggccatgtgtaagagaggcagtatggccactgatgttatttatttttcaacacgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccactgttatcaacattacggcggtataaaaaaacatataccngaagaatcatactctaacctcttttttttttc

SEQ ID NO: 276353 - DNA, 1824 bp, Homo sapiens
aactatcggcttaggtcgaggccgggggtgaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactccccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaa

SEQ ID NO: 276354 - DNA, 995 bp, Homo sapiens
cagtactctcacggtttaaggtagcgaggctgggtggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtt

SEQ ID NO: 276355 - DNA, 158 bp, Homo sapiens
tttctttctcctcagttttttgtaaaagtttcagaaaaaatggtgttaattcttcttcagatatttggtagaattcactggcaaagccatcgagtctaggatctactctttctttctttctttctttctctctctctctcccccctctcctccctccc

SEQ ID NO: 276356 - DNA, 393 bp, Homo sapiens
tctcttgcctcagcttccccagtagctgggactacaagtgcacaccaccacacccagccaatttttgtgtttttagtagagacagggttttgccatgttggccaggctggtctcgaattcctgacctaaagtgacccacccaccttggcctcccaaagtgctgggattacaggcgtgagccaccacacccagctgcggaaggagttttgagatgggcagctgaggtggggagtcctcagaataagtacatgagtaccgtgaggctgcagaatctcctttctccctggaatcctttccctgtcagcagtatttctgatatggagcaaaacagcctctttcagaattggttcctgagcttaccccaatgacagtgtctttcctggaaccatttca

SEQ ID NO: 276357 - DNA, 864 bp, Homo sapiens
ccatgtgctgatgagaataatgtatcttctgtagtttttggacaaaatgtcctgtaaatgtctgttaggtccatttggtctaatgtccagtttaaatcctgtttctttattgattttctgtctagatgatctgtctaactcttaaagtagagtgttgaagtcccccactattattgcattggagtctatttttctctttagatctagctatatttgctttgtaaatctgggtgcaccagtgtttggtgcatacttatttagaattgttatttcttcttgttggattgatctctttgccattatttagtgacttttttatttcatttttttactgtttttctcttaaggtttgttttatctgatttaagtatagtttttcctgcttgctttgtcttgctttgcatctttgtcttccatttgtgtgaaatactttttccttctttttacttgagtctatatgtgttttgcaggtaaagtatgtttcttgtaggaagcatataattggatcatgcttctttatccatttagccagtctacatatttttaagtggagaatttaatcatttacattcagagttatggctgatatgtaaggctttgttcttatcatattgttaatttttttctggttgttttgtatattcttagttcctttcctttttttctattgtcttcgtggtttggtgattatgtataatggtaccatttgagttatttctctttctcatttgtgtgtttgctttactgttgaatttatacttttatgtgttttcatgatggcaaatgttgtcctttcagcttcaaattcccctgagcatttcctgtagaccagcctagtggtgatgaatactctcagcatttgct

SEQ ID NO: 276358 - DNA, 426 bp, Homo sapiens
ctctgtcacccaggctagagtgccacccaggctggagtacagtggtgtgattatggttcactgcagccttgaattcccaggctcaagtgatcctcctgccacagcctcccgagtagctgggactacaggtatgacccaccatgcctggctaattttttttttaattatttgtatttttagtagagacagggtttcatcatgttggccaggctgctcttgaactcctaacctcaggtgatccacccgcctcggcctcccaaagtgctgtgattataggcttgagccaccacgcctggcctgttagtgagttacttctctgtcttgcctccctttactgtgagttgcctgatggcagaacctgtgtttttattttggtatttcatgagctagctgtttggtcaaatgaataagtgaatgaagcatttc

SEQ ID NO: 276359 - DNA, 267 bp, Homo sapiens
gtgattctcctgccttggcctcccaagtagctaggactacaagcacatgccaccacacccagttaatttttaattttttgttgtagagaggtgagtcttgctatgttgcccaggctggtcatgaattcctggcttcgagggatcctcttgtctcagcctcactccactgtttataactctcagtgccttcccatctcagagctgatgccaagacatcccagtgcatatctggccatccctcgcactctttacctttccaccctccta

SEQ ID NO: 276360 - DNA, 759 bp, Homo sapiens
atggttaaaactattattattgtcatcattatttaaccaacttggctttatgtgctaaaaaaaaaaaaatatatttagatcaagttacacaagcatgcttctcatcttcccaaagcttacaacataaaatgagcaataactatatgggcaattgcacaaaaaaagcaatatgctgacaagataacatatccattcaaatctgtttatgctgaaattttagtgagcgtgagcttgggtttattagtctgacccactgattaaatagcattatttgagtcataaactacaaaatcagaaaaccgctaagagatgatgagattaaaacattcaccaaacaagaaatatgtcaaggaagagtcaaaaactttggtaccagagaggctttatgctgctagatacactttttttaaatcaaaataccaacttaattgttaatggaatttttaattatctattacaatccgaactggctaaaacacatagttccttataagctcaaaccaaacatttaattaaacctaccaagcataagtggcatattttttatcctgtcccgtaagcagaagtgtcagaaaaggccttttactctttgttaattgaaaaataaataggtttccaggagaacagagtcatctctttagaacaattcatccaccatgcaattgtacaatttatatctattctaggtaccaacccttgccattgcttagtctgataattaggagtagaaactagaaataaataaaagcattattttta

SEQ ID NO: 276361 - DNA, 1646 bp, Homo sapiens
accctgctgcccctctgactctgaacgcaccacagggcgtcagactggagccccatgggggactgaacttggccccagaagagctataggttgctgtgaccgctgccacaaccatttgggtatcactgcccaaatcaggggccacaagcatttctgcctcttccaggcctgcgagtgtcacaattgtgccctcttctcatgagtatggtgtctgagatgcggaggggccagacctcctctaaatgggactaatcttagccctgctatcctttgcttcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgtgtggtcttcacacacaaccacacacctccagggggcccggtaccaatcgccggaagtctattacatcctggcgcgttacacgttgacggaaccgtcgtccaactacctgagcatcccttgcgcgtgtatcacaaggcccgagcccccaaggcccacggaagaatacgacctggaccgcagtgaccctacaggggcccacacagagggatgcaacacacagcggcctccaatatccgcgggcgtgcggagcacgaccaccacacacagcgcccccccgccccc

SEQ ID NO: 276362 - DNA, 1607 bp, Homo sapiens
cctgctcctcctcctcctcctcctcctcctcctcctcctccttctcctcctcctcccggtctgagggcggcggtctccgactcaagaccctggggctccgggtcttcttagcagccgccgcagcagccgcggcgacgtcactgtcctctcggcctggcacacagcgctccggccgccgaatgcccgtggacgcgcatctcttcccagagttcctgcttcctgggccagccaaagccgcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggggagctcccaaggggctctgctgcttggccaggccccagaacctttgtctctgccctgtactccagtgaccttggagcagcaactggtttctccttctggggatccccacagggcccctgccctgcccagcatatgctcaactctgatcctccagccctgtgccacccttgaccctcttctactgcagccacaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgtgtggtcttcacacacaaccacacacctccagggggcccggtaccaatcgccggaagtctattacatcctggcgcgttacacgttgacggaaccgtcgtccaactacctgagcatcccttgcgcgtgtatcacaaggcccgagcccccaaggcccacggaagaatacgacctggaccgcagtgaccctacaggggcccacacagagggatgcaacacacagcggcctccaatatccgcgggcgtgcggagcacgaccaccacacacagcgcccccccgccccc

SEQ ID NO: 276363 - DNA, 1320 bp, Homo sapiens
ccctcagctctcccggaatccctttcgggaggactccttgctccagccccctgagccctggcctttggccaatgaggcagggctcatgggattgcttttgattcggaggtccgggagggagtggatgattgggcttcctgaggaagtgagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcactgggaaggagaacaacatgctgcagcccgagacccacatcttcacagcccccgaggaggtccccaaagtctctgaccaggctttggtttctgcccactcagagtggcagcggaagctggaggccgctgaggctctgctgactctgagaaactctgcccaggcccctcctgactccatctccctgcaccagccttgcaacccaccagctcctgctggagataaaggattccagcctcccagcccctctctccgccccaggccagccagctccatctcgctgcctattggacatctgggatgcatctccctcttgagctaggaacccagaggaggaggcctcaatagagcactgcctatttggtatccagtttctgaatgtgcaaaatggttaacgtccaaaacgcttaacgtctttttttaaagccttcaggtgttttataagctttttattatatggggcaactccttggctgagggtggatattcttgtacctctgtcccttactcttttggatgctggggcctttttctgtctcataaagacaggattgtgcaatctaagttgatcagtctctcagtggggttctgtgtgagttcatatgccagagtttttattcgtcttgtgattgctgacatacctgtgcactcatgtgtatacccctgcatgtggaaacatgaagatgttttcactttgtgtctaggtttatgtacgtgaacaaataataaaccgtgtggtcttcacacacaaccacacacctccagggggcccggtaccaatcgccggaagtctattacatcctggcgcgttacacgttgacggaaccgtcgtccaactacctgagcatcccttgcgcgtgtatcacaaggcccgagcccccaaggcccacggaagaatacgacctggaccgcagtgaccctacaggggcccacacagagggatgcaacacacagcggcctccaatatccgcgggcgtgcggagcacgaccaccacacacagcgcccccccgccccc

SEQ ID NO: 276364 - DNA, 363 bp, Homo sapiens
tgtctactggtagtatgtgtccgccagcggatttaatcccctggcctctcctttccttgtttctagatgctcaactctgatcctccagccctgtgccacccttgaccctcttctactgcagccacaggtcctgggaaagtagtggggtccagaaccctgggaggggcggagtttagtggatgggaagagcagaaggccttggtgggggtgggggaggaggttgagggaacagggggctgaaggggcacttgtcgtattgggaagaggtgtagtttcccagtgcctattctctcatgcactttcctttccaggtccccaaagtctctgaccaggctttggtttctgcccactcagagtggcagc

SEQ ID NO: 276365 - DNA, 473 bp, Homo sapiens
cctgctcctcctcctcctcctcctcctcctcctcctcctccttctcctcctcctcccggtctgagggcggcggtctccgactcaagaccctggggctccgggtcttcttagcagccgccgcagcagccgcggcgacgtcactgtcctctcggcctggcacacagcgctccggccgccgaatgcccgtggacgcgcatctcttcccagagttcctgcttcctgggccagccaaagccgcaggtgagaacgtccgcggtagaggtgacacccagggcctgcgggtctcagaggcccggtggcctgctcctctcctccttgcccaagaaacccccacgggggcgcctgcagcggggacaccaagtgctccccggagccctgggagcacttcttctgaggcatggagcccctgctcaggtgcttctgaaagttcctttgtggaccccagaaacccctaggcaactgtctgccccgcc

SEQ ID NO: 276366 - DNA, 1497 bp, Homo sapiens
atgtttttctaggtagaaaacttaacatcattttaataaatcgcttagcttaaaacagtacaatgggaaaatatggcttaatgttaaacaaaacaaatgaaaatcaaattaacattacttccccactctcatttcttccccccccaattaaaagaacccaagtacttatttcttaccatctgtcccagtaatccgccacacattttctgcttcctttaagcttctgatgtctccattagcaattacaggtatagacatattttccttaattattttaatggaatcatagtgcactggctgatgtctttcttcagcagttcttccatggactgtaatccatgaaactcctgttgcttcagccttttgacaaagatctacagttcttttaaggtcatcatggatcctacaatttcaaaattacatttatctgttcacagcacacaaatcttaatgctaacattaactgactaaaatggtatttcatctaccaaatcttcagggagcagttcctacacaagacctcaaatttagctatttcactattgacaacaaaggacaaaaaacaagttttatcttagacctagtgcttctatgttttggctttgataaatgaaagacccatgaaagtactgtcacagatgaatttaaaccttaatatttgctgtgcatgcccccatcccccagtgggagaatataatactttatcttgaaatatgttttcaggctgggcaccgtggctcactcctgtaatcccagcacattgagaggctgaggcaggagaatcgcttgaacccacaaggcagaagttgcagtgagccaagatcctgccactacactccagcctggatgacagtgagactccgcctcaaacaaacaaaaaaagactcttagaattcttgactcactaattacacacttatgtgtctaaaggaactaggacaaagctattcattactgtggtaacacagtaatgacttttctcatgatatcaagataaagcaaatggtagttttgatcctcagggtacaaagactggaagaagacagcgttattaatatatggagaacttgactggtttgagagggattcagcagtagaggactcggagatgagtaagggtacaggcaacagagtaggaaggacttgagttgatttttatttccagcttctactgaggacagctcttaagttcaccgttttgacaactctggcagcttgctacaaattgccagttccccgtacaatccatagttgactcaggtgaaaagctgttccataaagatagaactgttaattgttagaaccgtgtcctccaacagataaataacatgattttaaaaggtagatcttgcactttgggaggcaggcagatggcttgaacccaggagtttgagaccagcctgggcaacatggcacaaccctatctctacaaaaaatacaaaaattaactgggtgtggtggcatgtgcctgtaatcccagccattcaggaagctgag

SEQ ID NO: 276367 - DNA, 812 bp, Homo sapiens
tttacagagaaaaaccagagggcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttcattaggctccccaaagggacaagtactcacctcccagagacctggcccagcgggtcctcatggcagcaccaccctctcccggtgcccacgaccattcgtctcccacccggtgttctccaggattcccaaagacgcccgtttagatccacagagctggaagacagctgttcctggatcacaccagaatggagaagcaagctcctcccactagcagaaagcctttgctttctgtgcctggattcggaagattagttaagcactggaagaggaggggggaaacaacaactcgtttttgctttttagaaagaaaaaaacacattaatgagcccaagaaatacacgcaactctgcaactctgtagatttccacctgttcccatcctccacagtctcccatcccaccagcaacacacgtgagatatctgatgccttcccatcaataactctcacttagtatgggtaagcaaaaaatttccaaccagggatggaagttgtggagagatagagtgggaaagctcaaggagcattgatagggatcattaattaaaaatctaccaaacatctctttctctccctaatgtgcgagttacaataacatcactcaaagcagtttgcagccacagcttg

SEQ ID NO: 276368 - DNA, 675 bp, Homo sapiens
attgagcttaagacctctcctgcttgcccagctgtaacaagacccccctcctgtgtctcttccccagtattcctgctgggatagtatcagaaaaggtgaagccctagtcaggagcctagattttcattcccactgggcagtaatgatgtgtcccttccatccccccaccccaaacagtaacaagttccctctcatggtgtcaatggaggctatctgggaagcactaaggaggcacctctacccttcccagccaagatatgtgtgcagaagcctagcagggagctgggacttggactcccacctgatggcaacaaggtggtgctcccacatctctcactgcacggagtcagacgaggcctgcaaaaacaaatttaaataagatctagagtctcagcataatactaaaacatttcaggatacaattgaaaaccatccatcctaccaagaaccaggaaaactaaatgagaaaagagaatagatactaaaaccaaaaagacacagatgttggaattacttgacaaggactttaatgcagctatctttaaagtgattcaatttgctattgaattatgaaaaaatagaattctcaacaaagaaatagaagatgtaaagaaccagatggagatttttaaactgaaaatacaatagccaaaattttaaaaagtcaactgaaca

SEQ ID NO: 276369 - DNA, 2911 bp, Homo sapiens
  misc_feature (1)..(1): n is a, c, g, or t
  misc_feature (4)..(4): n is a, c, g, or t
  misc_feature (6)..(8): n is a, c, g, or t
  misc_feature (535)..(535): n is a, c, g, or t
ngcncnnngggcgtttcctccaaggctgcccaccagaaggacctgcccgagagggtagagggcatagggtcaagatcaagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtgagcactccccgccccgtccccacttattccagccgcgctccccagtcgcctccccgcaccgctgtggccagtccagtttgtctcccccgttcaggccgacagacccacattctgggttggtccccaattcgaccccttcccaggaacaccccgctccccccanccccgccgcctccattctggccaccctgctccaatccgccccgcaggtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaaaaaaaaagt

SEQ ID NO: 276370 - DNA, 1512 bp, Homo sapiens
aatgtggctggcaactgcgggggtagaagaactcaggcaaagtaggcacaggaatgggggagatgagagccaagggacaaacgccgagaaagcgttccgacaagcatgtgtgttcatacatgcatacccccaacaaagggcaatgcactgtgtaacagaactgaacacaatttaacaaagctgctcccagccttcctgtcacctctttggcagtagggcaggccatctcaacttcggacacacaaagacattctcttcaggaggaaggctgtcctgtgtggtggggacaaggcttcagttgcaagatggttgtctctccttcttcctgaataagacaacgtaccactgttataagattccaagtgaattccttcagaggaagagaaggacaacataagaaggcgtggatgacagactttcagttaaactaacaaagaaagaacactgcagcaccatctatgcctacctttttctcagcgtttataaaaaaaaattcatattccctacaaagcaaaactatggtataacaggacaactaagactgccctggcaccagagaaactacaatctagatgtgctctgcttccagtcggccgagaagcctgcagcaaatcacctaaacacttaaggtctttgtgtgccatccacacccaactgcaactagagactttcattagcccctttctgtctcagagctttcggtggttctacaagtcaccagcctggatctctaacaatgtgtctctccaaagctgttaatacattcacatccaaaatatctccagccacgaaatcctagtttagaggttgcccgtccttgttgaagaaacatttctacacaaatacctgttgcctataccagatggccataccaatacccaaatactgacaaacgtttaaaagaatttacggtactcccttcactttagaaatgttaacagttcaagtccaacagaacttaaaggaaaaaaagagaaatgttaacagtaagtaaggcatttatttaacataatctcaactaaagtccaactaaagagcttccccaggcaaacactccttttgcacttcattttgaagacaaaagaatgcacaagttaaaatcctaatattaccattttattaaaaataacttttaagatccaatctgtggccaatattcgatctggatgcaaaaccctggcttccagacaggccagccaggggcactgctctgaaggtcattacttaagtatcccagtctcctcagtctgacagacctacccctgcccagccaatctccacataacagctagttgttcataataaatcccatcagatccccgcttaactactccccttcaaaggctccactgccctcaggaaatagttcaaccaccttctgtagaaaggccttctaaaacctctctccgagtctgtctgctaatctctcccacttgacactccccaggtctctggccagctgaacttcccgggcatttcctgaacaatgcccctcaataaaccacatgcaac

SEQ ID NO: 276371 - DNA, 479 bp, Homo sapiens
cggcttgggccccgcccaccaccccagcacgttcgaggagggctaagcccagcgtgaggctcgttggctcgacagaggcacgtgacgggtcctgagccaatccgtggaaggtaaaagctgcttcctgttgggacacgagtccggcgcgtgtcgggttttgagctgccgcggtcccgggactgaggtgggtggcggggtccgcccgtcttgggcgtcactcctcgccaaacctttagctcaagtcttaatgactgtcctctctgtggttctaatccgagctccagcctcacgggttcctacaggggcgggaccacctggcccaacctctgccttggtccaacgcccccggtttcctccagggccttggtccaacgcccctcggaggtttcagcccatttcacagaccgggccgcagggccccggcgtaggcctcgcgaccggagaggccctcaaggggagttgaacagggctgcggccgc

SEQ ID NO: 276372 - DNA, 864 bp, Homo sapiens
ctcagagctttcggtggttctacaagtcaccagcctggatctctaacaatgtgtctctccaaagtggaatgaatcagggcagctggccctgcccaccaggaacctggcagaggatggagagactgtcgcaagggaagccacgaaatcctagtttagaggttgcccgtccttgttgaagaaacatttctacacaaatacctgttgcctataccagatggccataccaatacccaaatactgacaaacgtttaaaagaatttacggtactcccttcactttagaaatgttaacagttcaagtccaacagaacttaaaggaaaaaaagagaaatgttaacagtaagtaaggcatttatttaacataatctcaactaaagtccaactaaagagcttccccaggcaaacactccttttgcacttcattttgaagacaaaagaatgcacaagttaaaatcctaatattaccattttattaaaaataacttttaagatccaatctgtggccaatattcgatctggatgcaaaaccctggcttccagacaggccagccaggggcactgctctgaaggtcattacttaagtatcccagtctcctcagtctgacagacctacccctgcccagccaatctccacataacagctagttgttcataataaatcccatcagatccccgcttaactactccccttcaaaggctccactgccctcaggaaatagttcaaccaccttctgtagaaaggccttctaaaacctctctccgagtctgtctgctaatctctcccacttgacactccccaggtctctggccagctgaacttcccgggcatttcctgaacaatgcccctcaataaaccacatgcaac

SEQ ID NO: 276373 - DNA, 327 bp, Homo sapiens
  misc_feature (1)..(1): n is a, c, g, or t
  misc_feature (4)..(4): n is a, c, g, or t
  misc_feature (6)..(8): n is a, c, g, or t
ngcncnnngggcgtttcctccaaggctgcccaccagaaggacctgcccgagagggtagagggcatagggtcaagatcaaggtcagaggcccccttgggttgggagaggacacggaaggggttaggagcccaggaactgggtctcaggagagacccaggatctgacttaagaggcctgaaaatgcccatgcaattctgcttcacccgggtgcagcggctcacgcctgtaatcccaacgctttgggaggccgaggcgggcggatcactcgagcccaggaatttgagaccagcctgggcagcatagcgagacccctgtctctattatatt

SEQ ID NO: 276374 - DNA, 2803 bp, Homo sapiens
cggcttgggccccgcccaccaccccagcacgttcgaggagggctaagcccagcgtgaggctcgttggctcgacagaggcacgtgacgggtcctgagccaatccgtggaaggtaaaagctgcttcctgttgggacacgagtccggcgcgtgtcgggttttgagctgccgcggtcccgggactgagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaaaaaaaaagt

SEQ ID NO: 276375 - DNA, 3366 bp, Homo sapiens
cggcttgggccccgcccaccaccccagcacgttcgaggagggctaagcccagcgtgaggctcgttggctcgacagaggcacgtgacgggtcctgagccaatccgtggaaggtaaaagctgcttcctgttgggacacgagtccggcgcgtgtcgggttttgagctgccgcggtcccgggactgagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaagtaaaaggattgtttttgtgaccctgaaaccaaggagaagaaagacctgggagtacagggcaggtgacaaagccaacaagactggaggaagcaggggcctcggccaggtcactgggaggaacaggactgctccctccctggggttggaacagacataggcgcgctcagtccgaggccagacaggggagacatggagaggatatcggtaccacccgcctacctctctgaaagactgtcttaagggagtatccaaccagcacttacaaagcagctttttgtggatgtgacactgggtggagaaaaagattcgatggaagtgtgtgctctgaacatcttagcttggatagcagggaagtctggaggagcgtcttgcctggagtggctggtcgccactagcctcttggggatccccaaggttgcctggctctgggtctcttggattcacagagcagtggggcataatcccagcacttcatttgatagtctgggccccttcctggagggaaagcagcagcaagacccagtggagacgatggcaaaggggctgatttcactttaggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaaaaaaaaagt

SEQ ID NO: 276376 - DNA, 2887 bp, Homo sapiens
cggcttgggccccgcccaccaccccagcacgttcgaggagggctaagcccagcgtgaggctcgttggctcgacagaggcacgtgacgggtcctgagccaatccgtggaaggtaaaagctgcttcctgttgggacacgagtccggcgcgtgtcgggttttgagctgccgcggtcccgggactgagctccttgggagcagacagctgtcctcactggcagaggaggagcgctcagtaaatgctcgctggacgaataaatggctagataagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaaaaaaaaagt

SEQ ID NO: 276377 - DNA, 3099 bp, Homo sapiens
  misc_feature (723)..(723): n is a, c, g, or t
cggcttgggccccgcccaccaccccagcacgttcgaggagggctaagcccagcgtgaggctcgttggctcgacagaggcacgtgacgggtcctgagccaatccgtggaaggtaaaagctgcttcctgttgggacacgagtccggcgcgtgtcgggttttgagctgccgcggtcccgggactgagctccttgggagcagacagctgtcctcactggcagaggaggagcgctcagtatatgctcgctggacgaataaatggctagataagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtgagcactccccgccccgtccccacttattccagccgcgctccccagtcgcctccccgcaccgctgtggccagtccagtttgtctcccccgttcaggccgacagacccacattctgggttggtccccaattcgaccccttcccaggaacaccccgctccccccanccccgccgcctccattctggccaccctgctccaatccgccccgcaggtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaaaaaaaaagt

SEQ ID NO: 276378 - DNA, 3015 bp, Homo sapiens
  misc_feature (639)..(639): n is a, c, g, or t
cggcttgggccccgcccaccaccccagcacgttcgaggagggctaagcccagcgtgaggctcgttggctcgacagaggcacgtgacgggtcctgagccaatccgtggaaggtaaaagctgcttcctgttgggacacgagtccggcgcgtgtcgggttttgagctgccgcggtcccgggactgagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtgagcactccccgccccgtccccacttattccagccgcgctccccagtcgcctccccgcaccgctgtggccagtccagtttgtctcccccgttcaggccgacagacccacattctgggttggtccccaattcgaccccttcccaggaacaccccgctccccccanccccgccgcctccattctggccaccctgctccaatccgccccgcaggtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaaaaaaaaagt

SEQ ID NO: 276379 - DNA, 2142 bp, Homo sapiens
ctgatctagaggatcccaaagctcgcactcttgaacaggggagctctacacctggggctggggtaagtaaaaggattgtttttgtgaccctgaaaccaaggagaagaaagacctgggagtacagggcaggtgacaaagccaacaagactggaggaagcaggggcctcggccaggtcactgggaggaacaggactgctccctccctggggttggaacagacataggcgcgctcagtccgaggccagacaggggagacatggagaggatatcggtaccacccgcctacctctctgaaagactgtcttaagggagtatccaaccagcacttacaaagcagctttttgtggatgtgacactgggtggagaaaaagattcgatggaagtgtgtgctctgaacatcttagcttggatagcagggaagtctggaggagcgtcttgcctggagtggctggtcgccactagcctcttggggatccccaaggttgcctggctctgggtctcttggattcacagagcagtggggcataatcccagcacttcatttgatagtctgggccccttcctggagggaaagcagcagcaagacccagtggagacgatggcaaaggggctgatttcactttaggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaaaaaaaaagt

SEQ ID NO: 276380 - DNA, 1893 bp, Homo sapiens
cggcttgggccccgcccaccaccccagcacgttcgaggagggctaagcccagcgtgaggctcgttggctcgacagaggcacgtgacgggtcctgagccaatccgtggaaggtaaaagctgcttcctgttgggacacgagtccggcgcgtgtcgggttttgagctgccgcggtcccgggactgagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgaacaggggagctctacacctggggctggggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgta

SEQ ID NO: 276381 - DNA, 1812 bp, Homo sapiens
cggcttgggccccgcccaccaccccagcacgttcgaggagggctaagcccagcgtgaggctcgttggctcgacagaggcacgtgacgggtcctgagccaatccgtggaaggtaaaagctgcttcctgttgggacacgagtccggcgcgtgtcgggttttgagctgccgcggtcccgggactgagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggcatggacagctgggccatgggaccctggaggcagagctggagccacggctgttggaggcgttgcagggcctagtcatggctgaggtggccgcggggggctggcattctgtgtgtgtgagtgagactggggatatttatatctggggctggaatgaatcagggcagctggccctgcccaccaggaacctggcagaggatggagagactgtcgcaagggaagccacgaaatcctagtttagaggttgcccgtccttgttgaagaaacatttctacacaaatacctgttgcctataccagatggccataccaatacccaaatactgacaaacgtttaaaagaatttacggtactcccttcactttagaaatgttaacagttcaagtccaacagaacttaaaggaaaaaaagagaaatgttaacagtaagtaaggcatttatttaacataatctcaactaaagtccaactaaagagcttccccaggcaaacactccttttgcacttcattttgaagacaaaagaatgcacaagttaaaatcctaatattaccattttattaaaaataacttttaagatccaatctgtggccaatattcgatctggatgcaaaaccctggcttccagacaggccagccaggggcactgctctgaaggtcattacttaagtatcccagtctcctcagtctgacagacctacccctgcccagccaatctccacataacagctagttgttcataataaatcccatcagatccccgcttaactactccccttcaaaggctccactgccctcaggaaatagttcaaccaccttctgtagaaaggccttctaaaacctctctccgagtctgtctgctaatctctcccacttgacactccccaggtctctggccagctgaacttcccgggcatttcctgaacaatgcccctcaataaaccacatgcaac

SEQ ID NO: 276382 - DNA, 2443 bp, Homo sapiens
tttttttttttaggagttagacatttatttttaacaattaaccactgaattcattttcagaaataggcctgaattgcttgttaatttcattacaggaagtaactctaaaagccaattccacttccaaactataattaccatcatctgaatttaacagggaaagacatcttccaagacttcttttgggtggatgcttagttttagaatagccaactttaccctaacccatgtacaagacagttctccaggtggccttggactgacccagttctcccttcttccttgcttgtagttcttaagaataactgtagaatgcactgggaatgcaatatcctgatatggaggaactgcctgaaacaggttggccttgttgttgtccctcctagggaatgtaacatcttgatttagggaactgtttgagacagcgaggttgtgttcctctttcccctggaaggaggatgtactttaaagctttgcccaatgagttatgtggctcctatggtatataacccaaggcaggctgtggtgcaagtggggcacgtacaatcaagactccatcagccccgccctgggcagctttcttgagccctgggggactggctcacaatggagccagggcctcttttgtcccttgcttcctgtctgtaagtaataaatctgcttcatgtaatgtattgggtgtgagtgtgttctgtcacaatggaatcagacaggttggtaaccagtgtacactgaacctgcttggcaccatgtagccctgggaaaggagaaaggcggtcacagcttgccctatatggtgatgccagcacactgtgcactgtactgtgcaacagaaaaaggtgcactgaggaggatcggctgcttcttcccattgttgcttctttagtaaatcccctatgagtttttagtcgctttctaatctacaagttaaaggatatctcattaatttttacagatatatacatatactgtaacaataggaagtctttcaccaaccactaatactgtaaagaaagcattgtatcgatctagtattatttaatgaagacggacagcaattttaatacaatcttcttttccaagacctttgacagaccttaggcccattttccacctttatgtctaggaaagtataagtaaaacacttttgagggcataaaaaacacaagcttcttgttaaggtgtatcagtagccagggaaatctgctgtgcccctttgagggtcatctaactaaggcatggagaaagaaactgcctcaagtcagtttctatcacctctgcagggaagctggccatgcaaaccaggacatggttcaaagtgaaaaagagtgtggttaataatcatgccagaacaccaggtataagatgtaagggcaagtcaggcattctgtacattgcttctcccttcagtttggaaaactcactgcagtagggttttgacttatcgtttcacaagacagctaggaaggccaggcacagtggctcacacctgtaatcccagcactttgggaggccaagacgggtggatcacgaggtcagatcgagaccatcctggttaacacggtgaaaccctgtctctacttaaaatacaaaaaatagccgggtgtggtggcgggcgcctgtagtcccagctactcaggaggctgaggcaggagaatggcgtgaacccgggaggcggagcttgcagtgagccgagatcgcgccactgcactccagcccgggtgacagcgcgactctgtctcaaaaaaataaaaaaaataaaaaaaaataaaaaacaagacagctaggaggaaagcctgtatgctttggaaaatgcatatcttgtgtgtttacccttttaaaggtaactatactttgaaacaggtgaactgcagaaagttaacaaagacttctttttttaccatgtttacctttctaagaattctatgcatttcctagggcatacatgcaaaagccttcacatttccccctttttaaaagagatatttctcaaacttatacgtatacagttcagtagtgttaagtacaatcacacttgttttgcaacagatctctagaattcttgcaacacaagctctgtacccactaaatacaaattcaccctctccccttcccccaaccgttgcttggcaaccacctttctactttctattgtatgattttgactactttgcatacttcacatggaggaatcatatagcatttgttcttttgttggctggcttatttcacttggcataatgccttcaaggttcatccacattgtacatttgacaggatttccttctttttaaaggctgaataatattccattgactgtatataccacatttcctttatctattcatctgttgatggacatttgggatgcttccagaacctcttggctattgtgaataatgctgctatgaacatgggtgtacaaatatctctttgagatccc

SEQ ID NO: 276383 - DNA, 253 bp, Homo sapiens
attgcattgtccctgcaactgtcgtctattgtagctgactgctgaagaggaaatgaaaccaaatagaaggttgtttgtaagcaatctctctgctcttcttaaaaataaattagggatatcaggatcggctcatggctagaatgaggacatagagagacatgcagaaattctgtttttatattgaggtgaagaagtgggtagggagggctttaaggattatctaatccaaccttctcattttgcagcagtggaa

SEQ ID NO: 276384 - DNA, 317 bp, Homo sapiens
cctagaaaagaaaacgcagagcacatcaaattaagttttctcttaatgattctttttctcctttttttatggcagggtttcactctgttgcccgggctgtagtgtagtcttggctcactgcaacctctgcccccaccccaggctggagtgcagtggcatgatcacagctcactgcaacctctgcctcctggactcaagctgtcctcccacctcagcctcccaagcagctgggattatgggtgcccatgaccacacccagctaagtttttaaatttttttagagattgaatctttctttttctcagcctggtctcaaa

SEQ ID NO: 276385 - DNA, 281 bp, Homo sapiens
gaaaagtctgtatactttataattgcaattatatgacattctggaaaaggcaaaactcaccagtggtaaaaaatatcattaggtgccaaggttcagggaaacacaagggattaattagggttgtgaaattattggatacatggcattatgcatttgtccaaatccacagcacttacagcacaaagaacaagtcttaatgtacgcaaactttaaaaaaactcatttagaaggttgatggatctgaggatggaatgcaggaggtgaaaaaataatataactgt

SEQ ID NO: 276386 - DNA, 388 bp, Homo sapiens
aggaatcctgcccctttcatccaccactgtgttcctggcttctactgccatgcccacatatcctggcggagattcgaagttgctttgttgaatgagtaaaggggggaattaacaaacttccctggcccctgtgtttatgaaataagaaaatgtggccgggcacggtggctgacgcctgtaatcccagcactttggggggctgagacaggtggatcacgaggtcaggagatcgagaccatcctggctaatacggtgaaaccccgtctttactaaaaatacaaataaattagccgggcgtggtggcaggcgactgtagtcccagctactcgggaggctgaggcaggagaatggcgtgaacctgggaggaggagcttgcagtgagccgcga

SEQ ID NO: 276387 - DNA, 417 bp, Homo sapiens
gatagttttttgtttataagtatgaacagtaaaatagtaagaagctaaagttttctgtggtgtgaacaccacttctaaactacattttgatgtcaaatttttagaggcagtagattaaataaaagtagatggatacagtattatagatctgatcatcacattaggtctataaacctgagagaacagctgctgtcctagttttcaagcaaataaaggtaacaatgggacattattggagctaaaaaagatatagcctatcaactcaaataagccccttggtatagaattagcaccatgattcctatactcatttaacaaacacttattgagctcttactgtgtgccagaacctgagattaaagtaatgaaaatgatagtccatcagtctggccaacatggtgaaaccttgtctctact

SEQ ID NO: 276388 - DNA, 502 bp, Homo sapiens
tcacttcttctgtgggacgctgccctatcccccagttctgctcactccagtgtattccgtatctaggctcctcagcagccaactcccaccttcctgactctagctggtgtccactgagggacacactccaagtcagttcccaggtcctcaaataccagctgaatgtctaacttctgggtgtgacattccagcccctagaagcctggcctctgctgctcccctgtccttccatgggtccactcctccttgcgccgggggggatgaccctcacctcaccttccggtcgcagctctagctgcctcctccctgaagccctctctgactgccctgccgattccgggccctcgggagcttccgcgagcagggccgtggcgcaatgcatctctgtgcccggcaccaagaaccggcccgggttatagggggcgccaataaatctttctggaacggagcccccgctctgtccgggtccccgcatgaagcctcagtttccagcgaccgcgct

SEQ ID NO: 276389 - DNA, 414 bp, Homo sapiens
acagtcttttttttcctccttagcatatatccagatagttatagatatttcatatatatgaaaatatatagattatctatacacacctgtatgtataaatacatacacatacattttatgcatttaccatttctatattctagtgttgtaagaacactcatttgtcacttctaatgaggcatgcatggccttcagggtaaaaagagaccatttaaatggagctgttcttaggtgacatgttttttctactattactgtaatatggatggatatcagtgagaatcagagaatatttttccttattggttttaatccttttctatcacatttttaaaataactataatttaggtcttagccaataggtaggccttttattttttctgaagcagatgattctggaaagaaataatcg

SEQ ID NO: 276390 - DNA, 161 bp, Homo sapiens
gaacaatccatttgaaaatggagagttagggctaggtacggtggctcatctgtaaacccaggccttagggaggtcaaatggaatcgcatgagcccaggagcttaagaccagcttgggtaacatagtgagacccctgtttttactaaataaataaataaagc

SEQ ID NO: 276391 - DNA, 340 bp, Homo sapiens
aggatctctctgttgctcaggctagagtgcagtggcaagatctcggctcactgcaacctccgcctccgtggcacaagcagtcctcccacctcagcctcctcagtagctgggactacaggagtatgccaccacacctggctagttttttgtatatttttttgtaggtacaggttttctgcttgttgcttaggctggtcttgaactccaggactcaagcgatcccccttcttcggcctcccaaagtgttgggatgacaggcgtgagccaccatgcgtggcccatttttattttttaacttgtcgttttgaaaaaatttcagacttaataaagttgcaaaagt

SEQ ID NO: 276392 - DNA, 497 bp, Homo sapiens
ctgcctcagcctcctgagttgctaggactacaggcacatcccaccatgcctggctaatttttaaaatatttttggaacccccatctcttgaaaaaaagaaaaaagtggataaagtaattctaataaggggttgggaggtttagatgaggtaatatgttaagcactctggtgtctaacgcacagtgggtcaattaagtgttattattatgattgtgattatttctagaaaataaggactataattgggtcctggtaattgtctttttttttttttaatcattttaaagtttttctggaaagagaaagcctctgacatgggctgaaggtgctctctcttctgagtcctaggaattgtacaaataggtactccttggaatctgtgattttcattgtttattattattctagaaaccctaatctgctctaacagtgttgggctcatagtagacagcacatatgtatattaagtgagcaaataaatgaatgtaaatgtgttc

SEQ ID NO: 276393 - DNA, 798 bp, Homo sapiens
acccgagaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaa

SEQ ID NO: 276394 - DNA, 749 bp, Homo sapiens
acccgagaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaa

SEQ ID NO: 276395 - DNA, 1209 bp, Homo sapiens
gcttatcttcactaacagtaagagaaatgcaaattaaaattactctgagatgctgttttgcctgtcacgttgggaaagcttaagaaatttgagtatacctgtgtcgcaaagtgttgggattacaggtgtgagccaccacgcctgacctacaatattttccttgtctcaaaaagagaccactcgccttagctattactctccagtcattccgttctcccactcattccattctcttctccagccctaggcaaccactgatcagttttttctcgcgatagatttacctactctggacatgtcatataagtggaatcatacaatatacagtcctttatgactgtcttcttagcacaatgcttttctgttttgttgtagcatatatcaatagttactctttcttttttttttgagttagggtcttactctgtcacctaggctggagtgcagtggcgtgatcttggctcaagtgattcttttgcctcagcctcccaagtagctgggattacaggcatgtaccaccaggcacggctaattttttgtatttttattagagacggggtttcaccattttggctgggctggtctcaaactcctgacctcaagtggtccacccacctcggcctaccaaagtgctgggataacaggcgtgagctaccgtgcctgagcaatagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaa

SEQ ID NO: 276396 - DNA, 918 bp, Homo sapiens
acccgagaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagagacggggtttcaccattttggctgggctggtctcaaactcctgacctcaagtggtccacccacctcggcctaccaaagtgctgggataacaggcgtgagctaccgtgcctgagcaatagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaa

SEQ ID NO: 276397 - DNA, 384 bp, Homo sapiens
tcccttgagtgtcactgtacattgtatatagttgaactggctttgaattagtggcataagggcataaaagaggaaacatttatagatttgaggagtagcatgttcttttgtaatgttattcagtcactgccaatttatttttaaaattaaagaactcaaatatttcaggtagtggtttttttttcttctatatagataatttaagtattttcttcttaaagctgctagtacgagctggcttcaagagcatgttgcagatcttagtcgaaggtaagatgttatggagtttcatgatatgcataatttacaggaatacacaagaaatgcatctatcatgggaacttaaattatccgttgctgaggttcctacgtgaatcacacagg

SEQ ID NO: 276398 - DNA, 734 bp, Homo sapiens
ggacttagcagtatcttccttccccgaatgaatccatttgttttgattgatcttgctggagcatttgctctttgtattacatatatgctcattgaaattaagtgagtattttttattgttgtcaagtatgttttgatttctggggacttacttttaagggcatcagcaggatggatagtggtcaagcttctagcagtttcgcttatgtcctgtgtaacttagatcacatcttttccttaggtgtcttcatctgaaaaattaaggggattgggttcaataagtatttcttaccacaatgtataatgcagactggaaaacaatttaaattccctactgctgacctgatgagtgaaacagaaaagagaacagtaagaaagagatctgagccaccactgctattgccgagagagggaggagaagaggacgtaggcgtgaaacaattttttaaaaataaagccttttaggaaataggctttacagctgctttaagcttaacatgttatggcatatgattctttggctacccaccttttaaatattagtctttactagaatttgtccttattgttcttgctgttttatgtattttccttaaaaatcacatgcaagtatttgtttttgtttgctacttctgtgggattcctagatttttatttctagcccacatctctattgaattccaaaaggcgtatcttcctgacttctataggtgtctactttaactgaacctattt

SEQ ID NO: 276399 - DNA, 489 bp, Homo sapiens
ctaactctgtagcccatgttggagtacagtggcatgatcatagctcattgcagccttcaacacctgggctcaagtggctctcctgcctcagcctcctgagttgctaggactacaggcacatcccaccatgcctggctaatttttaaaatatttttggagtcaggggtctcaccatattgcccaggctggtttgaactggtttcaagcgatcctcccacaccccgagtagctgaaattacaggtgtggagccaccgtgcccagctgttattgtcttttttcataaaggccattctatggtatgcagtggtatttcattgtggttttaagttattttccttatgactaattgagcacctttgcctatgttgattaaccattcagatcacctcttttttaaaatgcttgtaaaaatcttttaaccatttcctgtttttctgtattaatctgtaacagttctttatatataagtatcttctccttcttagttg

SEQ ID NO: 276400 - DNA, 683 bp, Homo sapiens
aggactataattgggtcctggtaattgtctttttttttttttaatcattttaaagtttttctggaaagagaaagcctctgacatgggctgaaggtgctctctcttctgagtcctaggaattgtacaaataggtactccttggaatctgtgattttcattgtttattattattctagaaaccctaatctgctctaacagtgttgggctcatagtagacagcacatatgtatattaagtgagcaaataaatgaatgtaaatgtgttctagagagactggtttgtgaattgaaagaattgtgatgatctaattaatgttttggtttcaggtttgaaagattagaagtcctggctgtatttgcctccacagtcttggcacagttgggagctctctttatattaaaagaaaggtacatttgtataggatattattctaaatccccccatgacacctttgggaacatgaaagaaacccgtcagacacatttgctttcaagggtatgaaaacttagatgagcagggctggagttttgatagtacactttctttatgtttcagactttttcttctgtttcattttttttacttccttccttaatgctactaaattgaatcagaagtggttgtgaatgaaacagagattcagtcaggcatgtttgatgcttattacaaacccattgaaatag

SEQ ID NO: 276401 - DNA, 1209 bp, Homo sapiens
cataccccacacagtctccaggcgggaagaggacttccttcttcgtgatcaatatttgcgtagcactttgcaagtgttttcgggttcatcattgcatacaaccagaggaggaaaagaaaagcaactggatccccttccgccacctccaggtctcctaaaggaagaagtccttgggaacccatactgtgtgatccagggtccttcactggcctctccctcaggtcatccagttgtcaatttgttgctttggcttagtttcaccattagcagtactcttcttggacacaacctccagagtaaaagcaaatgccggatgcggtggctcacacctgtaatcccagcactttgggaggcggaggtgggtggattgcctgagctcaggagttccagaccagcctggacaacatggtggactttccagaaaatatgtagctacccagctacacctgcactggggtcaggatgatccccagggggctcagaacaccagatcaacagtgaagccacagttgccgagctccacatcatacgttatggctgtgattcctgtgatagcttgagtgaggccgctcagaggcctcagggcctgactgtcctgggcatcctaattgaggtgaaatgctgagccttggtgtaggaatcttggttggctctctctgacttctgctggccattttcttcatggctagaaggcttcagaacaagaggctggaaaatcagaagagcgtggtcatcacctcagcatgagccaccactgaggcataaactccctcttagataccttggatatggatgccttcccctcgtgcctccagaggtgctttcccctcatgtctcaccacccctcagggaacctctaaaatggggtgcagggactggccggaattactgtaggagtagtaggcgcttctcctctggacatcccctgcagagaggtatggacccaggctctcattcaaggaagaacagcagagccttcagcccctcaaaacatgtaggaggagatcagggcatccctgtgttgttagtgcagaggacaaactgtgtttagttttaggggaagtttgggatgtaccccaaagtcctccaccatctcacctttatgtccctttccctagatatattgcaggatctccccttaggagaaagagttgctgttggggttatatatttttgctcaacatatttggaaactaaagtttctggagg

SEQ ID NO: 276402 - DNA, 406 bp, Homo sapiens
ctccttttacagagaaattgtaattttgttgttgaattatacatttttaagtcaagacttgaagtatagttactacatcatcatatataaaatgttttctttgggtatggctgctgcagcccttagaaaccaacgtcatcactgagagtgtcacagactttaacagtccagccttctgttccgccagggcacttgaggatctgttctatttgctgctttaaaataacagccctcccttattctgaggagaggcaaggatccatcggcctggactatttatcagtggtttctgaagacaggagaatgtttattttgtgagaacatttgtcctaccttaatttgcaagggacttaaaaagtagccaccatgaaacacaatagtaaatatttgattcttgtgaaacagg

SEQ ID NO: 276403 - DNA, 511 bp, Homo sapiens
ccagattgagaaggtatggtggataaagcgatgctgccttgggaaaatatccaaatgtaactcaaagaaccacaagaccctataactctcaatttgaagatggcgtgataattttataccctgaacctgttctctgcttgggacacagaacaaggatagatacaccattcggagcctgttttctgaccacaggagaatgaaccaacacattgaaaacaaacagatcaccagaaaatttctactctttaaaaaatagtcagcatacttccaaataatccacatcaaaatagaattaacaaaaaataatataagttagttggtctacaatcaaaaacaatattcccatggttatagacaggaggagccctcttccatccgccgctgcctctatgaaattccagcatcatttttctggttttcatttggaaacaaagccactgaagagtattttgaagagtctgaaatccataaaacagagagcaaataaactgaaaatagaaccggaaaactt

SEQ ID NO: 276404 - DNA, 805 bp, Homo sapiens
tcttctgtttctctttgaagtgcacatagtggccctaaaggcataggatattctaaagatgtaccttgtccatctgagttatcggaagtcaagccgttaggactgtgctcttctgagctctgcctgtaaagccctgcagacaacctcctctcggcatgctgcagtctctcatagccagcttggttgcaaaggaactccatctgctttgccatcaccttttcaggctgctactgaaagtggactcacagagggctgtgttccagtggacatgttattcattccgtctaagcagaaggattccaacctcacttactaactagctgaagaaacgtttccctagagatttcattccaaatggtaggttccttaaggcacacctaagctagcaggcgatctttttctccatgtccatctcatatattctaggaattaaagttcaaaatctgttttttaatgtttaacataccctgtaaggaggaacactatttaaggacaacagattatcttgattacttctatgcaatgtgtatactgctattttttttttaaatcaaataagtaactatcctttaagggggaacaacctactacataaataagagctttccaggtagaaaaatcagacaagtcaatgaattataacttcattccacccaagccttcatgtatagatcaggaaaacacagtatttaggaacgaaagatcttactgagcttgaacacagcactacttgtattagtgtaccctaatgcattaataatgacaagcaaaaaaatgtttctctttcctttacatgtcaaattat

SEQ ID NO: 276405 - DNA, 809 bp, Homo sapiens
ttgttttcctcagtaaatattagcaataacttaaatgtttataagattcatctcatggattcttggggatatgcatggaatcaggtacagacagtgcaaaggtggtgtgcctagtgagcttggatgtatcaaacagctgtaagaaaatctctccaaccttctctgaataaaggaggaatgtggtgtttattgaggaacaggcaacccttacatttgaataaaagatgccatatactgaaagtggactcacagagggctgtgttccagtggacatgttattcattccgtctaagcagaaggattccaacctcacttactaactagctgaagaaacgtttccctagagatttcattccaaatggtaggttccttaaggcacacctaagctagcaggcgatctttttctccatgtccatctcatatattctaggaattaaagttcaaaatctgttttttaatgtttaacataccctgtaaggaggaacactatttaaggacaacagattatcttgattacttctatgcaatgtgtatactgctattttttttttaaatcaaataagtaactatcctttaagggggaacaacctactacataaataagagctttccaggtagaaaaatcagacaagtcaatgaattataacttcattccacccaagccttcatgtatagatcaggaaaacacagtatttaggaacgaaagatcttactgagcttgaacacagcactacttgtattagtgtaccctaatgcattaataatgacaagcaaaaaaatgtttctctttcctttacatgtcaaattat

SEQ ID NO: 276406 - DNA, 2146 bp, Homo sapiens
ctcccacctggcactgcccccaaccaaagtcatgagggcaaggctccggttcctgccctcacagggtcccagaagcaagggcagtgaggacctggcccacgtccctggcacgggctgtctgattctccttcgctgtggcgggaagatggccggatttgaaggcctccgctgctcactgctgtgccttgatcggcctggacgagcccgcccacacctccatcatacccagtgtgaagaggggctggggacccaccactcctgagaacagcatccttgggaagacccagctaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttc

SEQ ID NO: 276407 - DNA, 2173 bp, Homo sapiens
acctagatgggcgaatggggcccacaggggacctggagggcatggcaaggggccccaggggatgacgggtgtctggagaagatggtggggaatgagggagggtgtgaaatgaaggtgtggtgggagtgtgggtagggatttggggctgtgtacacatgagcagggctgaagtgggaggacatcggagtagtgacatgaggagtgttttgccaaacttgcaactggagttaccccaaaagtggcggcaagggagttccccacactatcctcaggtgggaccagttgggataccaaagaaagaagtgctaaatgcatgaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttc

SEQ ID NO: 276408 - DNA, 1550 bp, Homo sapiens
gagaaggcgcccggctccgagacgaaggctacccggcccggagcctggccgacgccggggacatcgacccccaggcctcggaagtggctgtcggcgagggcgcgcgtctcgcggtccatccagctcagcacgggtcgaaggaccctcctcctcacttccgccggagcggaaacggtgaggaccagcctcggaaccagaagacgcagggcgccgcgtttctgccccgccagcgcctggggctccgggcctgcacgcatgcgcgcggctcgccgcggtcttcactgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcaggttagtgaccgacaaggcagtgagcgcgtgcacagacttctaaaattacaggcagactcagcacgcctgtgggaaatgcctaacagatgcgtcacctagagcagctgctggcctccagcttgctagagacagctcgtttgtttatacataaaaacaattccagaccattttc

SEQ ID NO: 276409 - DNA, 1476 bp, Homo sapiens
ctcccacctggcactgcccccaaccaaagtcatgagggcaaggctccggttcctgccctcacagggtcccagaagcaagggcagtgaggacctggcccacgtccctggcacgggctgtctgattctccttcgctgtggcgggaagatggccggatttgaagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttc

SEQ ID NO: 276410 - DNA, 1038 bp, Homo sapiens
ctcccacctggcactgcccccaaccaaagtcatgagggcaaggctccggttcctgccctcacagggtcccagaagcaagggcagtgaggacctggcccacgtccctggcacgggctgtctgattctccttcgctgtggcgggaagatggccggatttgaaggcctccgctgctcactgctgtgccttgatcggcctggacgagcccgcccacacctccatcatacccagtgtgaagaggggctggggacccaccactcctgagaacagcatccttgggaagacccagctgtgagtgcacagcaggcacagtccctcaggcccaggtgctatggggccgcagcagcatcaacagcctctctcagctgctgcagcagctctttgggctgtggtgagaacgcgctggtgtccactctctggaagtcggggtgcgcaaccaaggaggccagcacctctgtgatgcgcccaacatcaaaggctgcctgttcgaaacccaacccagcaccgtcctcagcggctgcctccctcaggaccaggagcctcttctcagcgatgaccttgaggaagtggtaaaactcttcaaagttgatgcccgagcaggacctcatgatgacctgggcagagggaagaggccagtgagctaacaccatggacacagtccaagctgcaaaggacccgacatgcgcccagtccccaaggacgaagaagggaccattaagacagaggcactgagaagctgcgcggtgaccaagggagtctgagccatgcagcctaaaagccttccccaggagggtagcctccatgcgtagccaccccacctggcagtggtggtgccagtcgggcatggagtccctccactcgctgacctcctcctgcacggcgcatagctcctgctgcaagaagcgccacatgttggccaggttgaagccattgacccagttgtggttgatggagatggtgtcatcctggaaggggcacagtgcaggcaggcctgagcccatggcaggtgccccctgaccaacccacatctcctgcgccag

SEQ ID NO: 276411 - DNA, 308 bp, Homo sapiens
tcatgtcccatgtggaccagttctggtgatttgctggaacattctgaagtcattctggggctccctgccttctatgaaactattttcagaaggtaacatccctttctttccttttgtttctcttttttaggaactggagaatgcattgcatcttcctcagggacccccgttcctggtctggcttccctcacttccctatccctgatgtctctaatctaaactttcctcaattaatctgtgtcctctcctagtcaggggaaaaaacatgtgtgtgtacctaatgaatgtaagataatcatattcacaga

SEQ ID NO: 276412 - DNA, 311 bp, Homo sapiens
tggggcatcctctgcaagaggatcccacgagagtccattccccaccacaggcctccgctgctcactgctgtgccttgatcggcctggacgagcccgcccacacctccatcatacccagtgtgaagaggggctggggacccaccactcctgagaacagcatccttgggaagacccagctgtgagtgcacagcaggcacagtccctcaggcccaggtgaggattcagcagcagatgggattccaccccatctgtggcctctccagctgtccacaggccctgcaaaggcagggaggtggcaaaggccagcccaa

SEQ ID NO: 276413 - DNA, 2202 bp, Homo sapiens
gagaaggcgcccggctccgagacgaaggctacccggcccggagcctggccgacgccggggacatcgacccccaggcctcggaagtggctgtcggcgagggcgcgcgtctcgcggtccatccagctcagcacgggtcgaaggaccctcctcctcacttccgccggagcggaaacggtgaggaccagcctcggaaccagaagacgcagggcgccgcgtttctgccccgccagcgcctggggctccgggcctgcacgcatgcgcgcggctcgccgcggtcttcactgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttc

SEQ ID NO: 276414 - DNA, 1601 bp, Homo sapiens
gagaaggcgcccggctccgagacgaaggctacccggcccggagcctggccgacgccggggacatcgacccccaggcctcggaagtggctgtcggcgagggcgcgcgtctcgcggtccatccagctcagcacgggtcgaaggaccctcctcctcacttccgccggagcggaaacggtgaggaccagcctcggaaccagaagacgcagggcgccgcgtttctgccccgccagcgcctggggctccgggcctgcacgcatgcgcgcggctcgccgcggtcttcactgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccaggaactggagaatgcattgcatcttcctcagggacccccgttcctggtctggcttccctcacttccctatccctgatgtctctaatctaaactttcctc

SEQ ID NO: 276415 - DNA, 1639 bp, Homo sapiens
ctcccacctggcactgcccccaaccaaagtcatgagggcaaggctccggttcctgccctcacagggtcccagaagcaagggcagtgaggacctggcccacgtccctggcacgggctgtctgattctccttcgctgtggcgggaagatggccggatttgaaggcctccgctgctcactgctgtgccttgatcggcctggacgagcccgcccacacctccatcatacccagtgtgaagaggggctggggacccaccactcctgagaacagcatccttgggaagacccagctgtgagtgcacagcaggcacagtccctcaggcccagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttc

SEQ ID NO: 276416 - DNA, 998 bp, Homo sapiens
gagaaggcgcccggctccgagacgaaggctacccggcccggagcctggccgacgccggggacatcgacccccaggcctcggaagtggctgtcggcgagggcgcgcgtctcgcggtccatccagctcagcacgggtcgaaggaccctcctcctcacttccgccggagcggaaacggtgaggaccagcctcggaaccagaagacgcagggcgccgcgtttctgccccgccagcgcctggggctccgggcctgcacgcatgcgcgcggctcgccgcggtcttcactgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccatcctggagaagggccatgccaagcactggttcagctccctgcggccg

SEQ ID NO: 276417 - DNA, 1098 bp, Homo sapiens
caattattttaatgttaaaattgcactggtgttagatattaacgaagatgattggaaaaaagtctgaaagatacatcatttctatattccttgcttaatttttataaaatattgggttttcccttaagatagttgaagtatttttcttgccatgcctatttatttttgcaaaaaaattatctgctatatagaaccaaagatagattcgctttgctatatattataactatacttgcttttgcaataaaacaacttgtaattcaaaaatgaagattatctgcatatagtatttatgtgtgtgaataacatcttggcatgcagaaaataattttggctgctttgaacaggattgttcattctacacttccctgaaattccatttttgggagtgtctatccttcaatggctgaatagttccttaaatcagacaagctcctggctatcttcataaccagcagtgagtagatcttcttaatatagctgtctgaccacatgtggaaggcagctagacttattgtatttacagcctggccactctagacatatgaatccaggctgactgcttaagtgcccatctcgtttgatataaactgtagaaaaggcaagcactttgttctgagtcttttatctccaaatacatagttgtctcaaaccaagcaagctttatcaaaatggcttatttgcagaatagttccaatgatataaatgccaactggcaagtcattccaaactgcttgaaggagtagatgaaccagaatctgagaatttggaaataggtcacagaaaaagcctccatttggctaaatatgacaattatctgagtatggttaaatacatacaattaaatgtctgaagccaatgagttgtttattctaacttgaaatatatttttgtgagaataaatgttagaaaagttagtttattttggaaacctgccgtgaaaggaaattctaaaggcttaacatgaaactgtctgcatttctacctgttagacaatggttgctcttgggctcttgttatacagtcatatggctacacgtttatgtaaagtttgcaaaagtttggtgttttgatttataataaaactgttatattatt

SEQ ID NO: 276418 - DNA, 431 bp, Homo sapiens
agtcaaataagtttcttgtctgttgcctggatttgacttcaaatttcacaacttattaacaaatgaaatcctagctgttcacctaatcttttaggtagggataatggtattgattttagaatgttagggagattaaatgaaataatgcacataaaagttagcatagtgcctgggaaaactgcattataagttctcaacaaatgttagttgtttttgttgttaaaattgttatcctcccaggagagcaatgtatttagaaattgagcctgtatttaaaaattgtgtctgtatgttttaaaaatattttttcaagtaatttaccatgatcactagatttgaaagctaatgcgtcttgagctttaaaatgtatatggattacccacagatcttgttaaaacacagattctaatattcagtaggtttgggtgggg

SEQ ID NO: 276419 - DNA, 847 bp, Homo sapiens
acagaaacataaaataagttttaaacttataagacttttattttaaaattactacaaacctcaatgtaggttataaagaagacttcaataaatggaaaaacacaccatacttcctgggatgaaaagactcaagtgcgagcgtgcaggcatctgtatacatagaggaaactgtttgcaaagctgagctgcacttatgtcccctcaagagtggcaaaaataaaagccaagcccagggcctccagaagtgagatctctggtaaattacctcccattttacgcttacacactgaaagaagagggtggagccatgtgtgttatagccctctcatgaacttgctttctgcccttgtgtcctgttggtggttcaacctgggattaagtggtcaaacctgaattaagatatgtagactcgtaatgtccgcagctctctggaagaaacagattgcctctaggagaaggtatcattatcctaggcctaaagttaataataatataatttttatatccagtgttcagcttataaatttaaccaggtacacacacacacacacaccacacacacacacagcaccaagagcaagaagcagcaaaaccaacagacaacagaaaaaaatctttaggtattggaattatcaaacagaaaaccatcatgctaagttgcaaaagtaaaaggagagatcaggacataatggtagtacactggaaactttaaaaaatgacaaggcagattttacaaagaactaaatagaaatttagatcaggaaataaattatttcagtgttgcaaacataacattagacaaagctgaagtgggcattagtgaactggaagatacagttcagaagaa

SEQ ID NO: 276420 - DNA, 895 bp, Homo sapiens
gtgttggagacacaggcccagagccactcctgcctacaggctctttagctgagaataagggccctgagggaactacctgcttctcacatccccgggtctctgaccatctgctgtgtgccccgaccccccctaccctgctcctccaccaagcctgatgccaagggctataaaccactggcccaacagaagcttggttcccagagaactggtccctgcctgggacatgctccttgctacagccccttgtgggagctcagagggcatggctgctccccctacggtccctcgcccagtggttctgtctctttatggcaggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggaggataggtgggcaggcagcggggcatcgcctgggaatggaggcgctggcagggacagaaggcccctagtcccatgtgacctccagtaaagttttggcaccaaaaaaaaa

SEQ ID NO: 276421 - DNA, 1907 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcaaa

SEQ ID NO: 276422 - DNA, 1884 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggaggataggtgggcaggcagcggggcatcgcctgggaatggaggcgctggcagggacagaaggcccctagtcccatgtgacctccagtaaagttttggcaccaaaaaaaaa

SEQ ID NO: 276423 - DNA, 1932 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccaggcctgaccgccgggctctcctgcagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcaaa

SEQ ID NO: 276424 - DNA, 1840 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggaggataggtgggcaggcagcggggcatcgcctgggaatggaggcgctggcagggacagaaggcccctagtcccatgtgacctccagtaaagttttggcaccaaaaaaaaa

SEQ ID NO: 276425 - DNA, 1310 bp, Homo sapiens
  misc_feature (1060)..(1060): n is a, c, g, or t
gtgttggagacacaggcccagagccactcctgcctacaggttctgagggctcaggggacctcctgggccctcaggctctttagctgagaataagggccctgagggaactacctgcttctcacatccccgggtctctgaccatctgctgtgtgccccgaccccccctaccctgctcctccaccaagcctgatgccaagggctataaaccactggcccaacagaagcttggttcccagagaactggtccctgcctgggacatgctccttgctacagccccttgtgggagctcagagggcatggctgctccccctacggtccctcgcccagtggttctgtctctttatggcaggaagcaatgaggctccccaagaacacacctgaggaaaaggacaggtgagcctggagggccggccgcaccgtgggcctctgtgtctggggagttggtggccaggatcccgagtacctgggtgctgtgacggggcgtggttggcctgggcgtgctgggtgtttgggaatgacttcccatcgcccgcttctgcagcctgctcagccctgttggggtgcagtgtgtccactgcctgcctgtgtgtgccgctgtgctcaggctctcctcttgctcctttcaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtaggggggcccgggggaccccaggcctcctgccgcaaagcaggaagcagctgttggggctgagttgctggagagcacggtggttggctgggctgagccaggtagggagacctcacttcacgggcagttcccggggctttggcctcctccaacagggccggggtgtccgctgccttctaagatctcgctcacggcggcaccacagacggagacccaaatgtgtctgcagagcccaccctgaccactgtataagtgtatactcccccaagaccccttgtatcacccccactgtcntgttctagaaaacacctatgtcagcccaggcacaatggttctcgcctgtggtcccagcactttgggaggctgaggcgggaggatcacttgaatagaggaggtcgagaccagcctgggcaacatagtgggaccctggctgtacaatagatacatatgagccaggcacggtggtgcctgtggtcccagcctgcccagccagcctcctgtctccagagaagttctccattaaaaaataatttagcaaatcaaa

SEQ ID NO: 276426 - DNA, 756 bp, Homo sapiens
cagtgagccgtgatcacaccactgcgctccagccttggtgacagagcaagaccctgggtcaaaaacaacaaaacacgagaaagcacacaaggcagctcttggaagtagatgcctcacactgacaggggccacagctgggcagagggtcccagagaaggagcgtctctctcatgggctcagcactttctgcagctgccctaagacctcatggtcttcgggttctttataggaaagacgcctcttttcagcatctggtcccagagaaagtgtcccctcagtccctgggaagtgtccctgggcagtgggcgggccgttagcctgaagctgcctccgggggccctccaggggatgactttgtctctagaactgtggtcctggttcctagagtggcggagagcctccagtgtgactgctcccaggcctcctgtggggctgagccctgcttggataagagaaagttttgttttctaagctcagtggtggggcttagccctctgtggggcgaaagcgggggctgcgctgggctccttgtgaggaggaggacgaagtccggcctgtcccagagcccgtcaggcagagaccctccttccggcagtttgctcagccttgatccatgtaggggctccctggggtccttgcaggtggcggccaaagccctggagatgggcgtgtttggcgcatatttcaacgtgcctgcccagccagcctcctgtctccagagaagttctccattaaaaaataatttagcaaatcaaa

SEQ ID NO: 276427 - DNA, 477 bp, Homo sapiens
tgagctgcgggtcttggggcaggagcaggacatatggtcagtggcccatgggagccagggttggagggaatggggttgcagcgtgaggagacagacctcagcgccagggtccccagacacccagtgcagcccacagtgggcagggtcacaggtattcagaggacctggggttcagtgcaggtccctgggctgtgaggccccttgtctgagggaaaggggccctggttctgtgcatgggacagaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcaaa

SEQ ID NO: 276428 - DNA, 1234 bp, Homo sapiens
caactcctttctctgggcctcaggttccccaagggcaactcagggtgatggctgtttccagaagcctgtacggggtgcctgctggggcggggcccacagggctcctggcggggcagaggtggggggtgccagccacgcccctgccctgctccccgcaaaagcacctgtgtgctcggggcagggggcggctgccgcaagggtgggacccgcgggttccgaggctttcctggtggtggagacgcgccgaggccgtttccactccaagccccttttccaggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcaaa

SEQ ID NO: 276429 - DNA, 1864 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggaggataggtgggcaggcagcggggcatcgcctgggaatggaggcgctggcagggacagaaggcccctagtcccatgtgacctccagtaaagttttggcaccaaaaaaaaa

SEQ ID NO: 276430 - DNA, 2012 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggaggaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcaaa

SEQ ID NO: 276431 - DNA, 1887 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagcctcctgcaggaagccaagacccaggctgcactggtgctggactgcttggagacccggcaggagtgacgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcaaa

SEQ ID NO: 276432 - DNA, 1018 bp, Homo sapiens
cagtgagccgtgatcacaccactgcgctccagccttggtgacagagcaagaccctgggtcaaaaacaacaaaacacgagaaagcacacaaggcagctcttggaagtagatgcctcacactgacaggggccacagctgggcagagggtcccagagaaggagcgtctctctcatgggctcagcactttctgcagctgccctaagacctcatggtcttcgggttctttataggaaagacgcctcttttcagcatctggtcccagagaaagtgtcccctcagtccctgggaagtgtccctgggcagtgggcgggccgttagcctgaagctgcctccgggggccctccaggggatgactttgtctctagaactgtggtcctggttcctagagtggcggagagcctccagtgtgactgctcccaggcctcctgtggggctgagccctgcttggataagagaaagttttgttttctaagctcagtggtggggcttagccctctgtggggcgaaagcgggggctgcgctgggctccttgtgaggaggaggacgaagtccggcctgtcccagagcccgtcaggcagagaccctccttccggcagtttgctcagccttgatccatgtaggggctccctggggtccttgcaggtggcggccaaagccctggagatgggcgtgtttggcgcatatttcaacgtgctcatcaacctgagggacatcacagacgaggcatttaaggaccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggaggataggtgggcaggcagcggggcatcgcctgggaatggaggcgctggcagggacagaaggcccctagtcccatgtgacctccagtaaagttttggcaccaaaaaaaaa

SEQ ID NO: 276433 - DNA, 1957 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagcctcctgcaggaagccaagacccaggctgcactggtgctggactgcttggagacccggcaggagtgacggtgcgggaggcctctccgggctctgtggcccctccctcgcccatccccagagggcagagctgtgacctcgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcaaa

SEQ ID NO: 276434 - DNA, 2013 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgccggccatccgggccggggagtacgaggccctccctaagaagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccagccaggacgtctgaagaaagttcagggcattggctggtacctggatgagaagaacctggctcaggtgtccaccaatcttctggactttgaggtcacggcactgcacacggtctacgaggagacctgccgagaagcacaggagctgagcctcccagtggtgggctcacagctggtgggcctggtgcccctgaaggctctgctggatgcggccgccttctactgcgagaaggagaacctcttcatcctggaggaggagcagcggatcaggctggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctgaagcttggttcccagagaactggtccctgcctgggacatgctccttgctacagccccttgtgggagctcagagggcatggctgctccccctacggtccctcgcccagtggttctgtctctttatggcaggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacggtgcgggaggcctctccgggctctgtggcccctccctcgcccatccccagagggcagagctgtgacctcggtggggacacagcttgttcgtgtggggcccggaggataggtgggcaggcagcggggcatcgcctgggaatggaggcgctggcagggacagaaggcccctagtcccatgtgacctccagtaaagttttggcaccaaaaaaaaa

SEQ ID NO: 276435 - DNA, 1093 bp, Homo sapiens
cactctccaccccgcccggctgctgtccgtctctgtggggtggggtgggggtcgcatagccaacgtgttctgaatgggtttcccagaatgaattctaatcttaaatgggactgtcacaactttattttgaatttaggtggtgagccggctgggcctggactccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcaaa

SEQ ID NO: 276436 - DNA, 1385 bp, Homo sapiens
cttccatctgcccagagaggagcatctggatcaaggtgctggccatgtcccagctggtggaatgcgtccccaacttttcggaggggaagaaccaggaggtgatcgacgccatctctggagccatcacacagaccccgggctgcgtgctgctggatgtggacgcaggcccttccaccaaccgcaccgtgtacaccttcgtggggccgccggagtgcgtggtggagggggccctcaacgctgcccgggtagcttcccgacttatcgacatgagcaggcaccaaggagagcacccccgcatgggggccctagacgtctgccccttcatccccgtgaggggcgtcagcgtggatgagtgtgtgctctgcgcccaggcctttggccagaggctggcagaggagctggacgtgccagtttacctgtacggcgaggcagccaggatggacagtcgccggaccctgtgccccttcagccctaaggagcggatcatcgagtacctggtccctgagcgcgggcctgagcgaggcctgggcagcaagtccctgcgcgccttcgtgggggaggtgggtgcccgctctgcggcccccgggggcggctcggtggcggcggccgctgcggccatgggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggaagcaatgaggctccccaagaacacacctgaggaaaaggacaggcgcacggcggccctacaggagggtctgaggcgggcagtctctgtgccgctgacgctggcggagacggtggcctcgctgtggccggcgctgcaggaactggcccggtgtgggaacctggcctgccggtcagacctccaggtggcggccaaagccctggagatgggcgtgtttggcgcatatttcaacgtgctcatcaacctgagggacatcacagacgaggcatttaaggaccagatccaccatcgtgtttccagcctcctgcaggaagccaagacccaggctgcactggtgctggactgcttggagacccggcaggagtgacgaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcaaa

SEQ ID NO: 276437 - DNA, 435 bp, Homo sapiens
ttggaaatctaaagtctagtattttttttcaactacagaaagctgaggtcctccaataaggaaaagcttctatccacctggaaaatttacaagtaatgattaacacatggtcataacccaaagacttcagatgtcatataaaatttattcgtagtcaggtgcggtggctcacacctgtaatcccagcactttaggaggccgaggtgggtagatcgtgaggtcaggagattgagaccattctggctaacacggtgaaaccccgtctctactaaaaatacaaaaaaattagccgggcatggtggcgggcgcctgtagtcccagctactcaggaggctgaggcaggagaatggcgtgaacccaggaggtggagcttgcagtgagccgagatcgcgccactgcactccagcctgggcgacagagcgagactccatctca

SEQ ID NO: 276438 - DNA, 423 bp, Homo sapiens
gcgtgtggaagcttttttctgagccatccgccctgtggaagccacacaggcaaggccagaggagaacagtggcacaggcattcagaaaagcccagtttcccgacgtcagtttgcctgaggtcaggcggagcaccagcactttctggctcttagaaaatgactcaacccctccaacctgcagcttacccctatgcaaaatcagggctgcccttgcaggactgttgggacgagtcagtgacaggggagtgtccagccctacctggcatgtcataagtgcactctatccattgggagctgttattttagaagcaggacttcgtgttgttgctatgtcttgcctcagcagagagaaacattttgctcttgacactgattgtcccttctcagctgtaaggaggccacagcccccttgattttgaaccc

SEQ ID NO: 276439 - DNA, 2483 bp, Homo sapiens
  misc_feature (1803)..(1803): n is a, c, g, or t
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagcgggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggtcggtggcctctcactgcctccgcggcagggttgtcaagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaatcncaatatggccttggtatggttttatttgtacttttgtgggggattcgtggatctttagattaaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctg

SEQ ID NO: 276440 - DNA, 2027 bp, Homo sapiens
  misc_feature (1347)..(1347): n is a, c, g, or t
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagcgggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggtcggtggcctctcactgcctccgcggcagggttgtcaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaatcncaatatggccttggtatggttttatttgtacttttgtgggggattcgtggatctttagattaaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctg

SEQ ID NO: 276441 - DNA, 1300 bp, Homo sapiens
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagcgggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggtcggtggcctctcactgcctccgcggcagggttgtcaaggtaacgctcctcagacaagggtggggcgcggcccgccccttttctcaccccgcctcctcctcagccccaccctccttcgctcctcctcttgtcactccctttcagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtggtaacgatcctccgccggacgttggccgcac

SEQ ID NO: 276442 - DNA, 1503 bp, Homo sapiens
  misc_feature (823)..(823): n is a, c, g, or t
gtgcagcccgtccctaggtgtagggtaatggcggccgacctggcaggtctcaggctccttgggatcccctcgagaagcccgttcatgagtgtctgaaactgtcacttgactgccagaagtgaaaacatcgtgtccctagtcacctgccatttgccttttcaaaaccatttcctctgttctctaggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaatcncaatatggccttggtatggttttatttgtacttttgtgggggattcgtggatctttagattaaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctg

SEQ ID NO: 276443 - DNA, 1254 bp, Homo sapiens
  misc_feature (574)..(574): n is a, c, g, or t
gtgcagcccgtccctaggtgtagggtaatggcggccgacctggcaggtctcaggctccttgggatcccctcgagaagcccgttcatgagttgtctgcgcttctaccctgaattgggctcccttggaaaataatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaatcncaatatggccttggtatggttttatttgtacttttgtgggggattcgtggatctttagattaaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctg

SEQ ID NO: 276444 - DNA, 940 bp, Homo sapiens
gggtaatggcggccgacctggcaggtctcaggctccttgggatcccctcgagaagcccgttcatgagtgtctgaaactgtcacttgactgccagaagtgaaaacatcgtgtccctagtcacctgccatttgccttttcaaaaccatttcctctgttctctaggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcaggtcagcaggaccagagcgccccttggtccctcccaacacatgagggtagtttgtgtggtgaggtcagggatagtgtctgcgcttctaccctgaattgggctcccttggaaaataatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattct

SEQ ID NO: 276445 - DNA, 2588 bp, Homo sapiens
  misc_feature (1908)..(1908): n is a, c, g, or t
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagcgggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggtcggtggcctctcactgcctccgcggcagggttgtcaaggtaacgctcctcagacaagggtggggcgcggcccgccccttttctcaccccgcctcctcctcagccccaccctccttcgctcctcctcttgtcactccctttcagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaatcncaatatggccttggtatggttttatttgtacttttgtgggggattcgtggatctttagattaaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctg

SEQ ID NO: 276446 - DNA, 1910 bp, Homo sapiens
  misc_feature (1803)..(1803): n is a, c, g, or t
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagcgggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggtcggtggcctctcactgcctccgcggcagggttgtcaagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtggctgtcacaaatcctctgcaccccaggagcgccgcttggacccccgggctcgctgcgtggtccatatctaggtcgggcctctcacggagactttcccaccagtgtaataaagaggagaaaacgtcacagcggaagggcctgaccctgctgcatccactaaggaaacagctacggggatgggaccctgggagctgctgtggagcctcatccaccgcttctctgaccccacccaggctgcttcccaggcctcagggtcttagtgtggacctccgggccgtgattaatgcagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaatcncaatatggccttggtatggttttatttgtacttttgtaagaggggagaggggttcttagagtttttgtcttcgagaaagtctgacgttaaggacaaacggtcgaacc

SEQ ID NO: 276447 - DNA, 2194 bp, Homo sapiens
  misc_feature (1514)..(1514): n is a, c, g, or t
ggctccacggccacatccgcaaaaagggtactggtgaacgtgacattttcacgaagccacagcccatggtcactccctgcaaagctctgaacttgcgcattcccaggccaggccgtggttgtctttccaaggcggctcagcttgtgctttgcttggagagagcggagggcagcagcacagtgacagcgtctgggacctcagaccagtttccacagccacttatgaaagcagacggctccatgggctggaggaggtgggacgctctggaaagaactcgggtgcgagtgggaaagaaaatcgagctgagcagcgggaagtcgaagtcgcgtgagtgaggaccagacactctcgatttaggcaaaggcggggtgcacttcccaacaacacatcctcctcactggcgagaccaggcctgcccttcaagttcctctcctgatttaatccccttggcgagggtttggcatgaaatcaatggccagcaagcttggtaaacgaagccgcctacaccgccctccccctccctgcacggccgcgccccgcctccgctcctgtctcaatctgggattgtcctcctgtagccccaccatccaccgtggggaacggtggagagactacaactcccagtatgcaccgcgatgcgcgcctcaccctgcatctcccagcccgcagccagctggcatcctagaccctctgccctgcgaccaacagccgggagcggaccagacaccagaactcccggaacggttgaagacggttccgctccctgtcccgcctttcgcagcccagcagtttcgccctgcggagaggagccttgctgtttccaaatctctcctgctgaagagacattggagctagggcggctagtttcacctggtaattgtgacaccctgtctcctcgagctgcaggcttttatgcttgtcatgttcgaagtttgataccttgcagatcaacaaagggtcggtggcctctcactgcctccgcggcagggttgtcaagacatgcgcagtgcggcccgtccctagggctgggttaagggccgcggatgtggcagttctcaggcctcttgggatcgcctcaagaagccccctcacgagtgtctcgatttcctgtcagccaacaaagggccgttcgcctttcatggcctccacagcagcgttgccgtgtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaaggtgaagaatggaacatttaagacaagtctggaaagtcatctgcctttaataactgtcgtttgtccttaacgtcagactttctccaagaccaaaactctaagaacttatttccattcttacaaatagtaaaaatgataaatcatatcaagtcaattgaaagtcctgcctgctgctttcctaaatcncaatatggccttggtatggttttatttgtacttttgtgggggattcgtggatctttagattaaaaaaaaaaaataggtttttgaacaatttttgcaagtttgcagctgttagttattgatttatttttgcaacccatctaattcttctgtctctctcctctcctcaggctcaataattccatgggtctctaaggctgtgtttattttctttaaattttgttgatttacttttatactccatttgattttttctatctctcaccttttctcagactcagtcatcccacaggtctgtaaggctctgttcattttctttaaacttttttttttcctctcctcagattggataaattatattgctatgtctctgtttctgaactatagaaaagctcaaaattactatttttatttctcattttttatatggctattttttctctgctgatgtttcacatctattcatttatgagaatattttcctttgccctcatgagcgtgtttataatagctgccttcaaattcttgtctgccgtttacatcttggacatcttggagatggctactgcctgctttttatcttgtgtatttattacattttcacgtgtcttcacgcatctcttgaattggaaattgtgccctggagactgtatacaagactggattaaaaagactggattctg

SEQ ID NO: 276448 - DNA, 274 bp, Homo sapiens
aaaaatgcaggggttgctattctaatttcagacaaaacaggctttaaaccaacagtgatcaaaaaagacaaagatggacattacataatgttaaagagttcaagtcaacaagaatatctaactattatatatatgtatgtgtgtgtgtatgtatacacaacacaggagtacccaaatccataaaacaagttcttagagacattaaaagagacttagataaccacatattaataatgagagacttcaacaccttattaataatattagtcaaatc

SEQ ID NO: 276449 - DNA, 295 bp, Homo sapiens
accacgcccagctaatttttgtatttttagtagagacggattttgccatgttggccaggctggtctcgaactcctgacctcaaccgcccgcctcggcctcccaaagtgctgggattacaggcgtgagccaccgcacctgaccctaaaggctattttaatagcttccttgcaacttcagcctagtctgaatacagcagccacagtgatccttctaaaacgtaagtgaaatcacattactcctctgcacaaaaccttccaatggtttatcatccaactccaaagttcttctcataac

SEQ ID NO: 276450 - DNA, 337 bp, Homo sapiens
accatattataccacctctccttgccctaatgcacaaactccaagtgcatatctggttttcatctagggggttttacatttgccccagctgctgaagataaggaccttctctctgttcctgaactatttgcaatatcatagaattgttttaggttatcttttttctggttatagagtaatacattccttataaaagctcaaacaatgtcaaaatgtaaatcttagaaagcaaaagtctcctctaattccaccttgcagaggtaatcaatgctaacagtttagtgtatattttggcattttcccatatgcatatactaataaataaatatttaaatac

SEQ ID NO: 276451 - DNA, 493 bp, Homo sapiens
tggaatttagaattgtaatatcttttagttcttactttccttctaactacataaaataatgttctgactttctcatcttccccaaaatcggtaaatgcatttgtcaatatgttaaggatataagccagggtgaacaatttggacatggaacatgtgatatattacacttaaatatattaaataccatgggagatgggttttaataagattcagcccaaataaattagtattcctttttatcctgggccagactttcaaaaagtggatacatctagccctttgaaataaacgtgatatttgtagataagtatatatttaaatctaagtatatgaatataaaaagtagccgggcgaggtagcaggcgcctgtagtcccagctactcgggaggctgaggcaggagaatggcgtgaaccccagggggcggagcctgcagtgagccgagatcgcgccactgcactccagcctgggcgacagcgagactacgtctcaaa

SEQ ID NO: 276452 - DNA, 441 bp, Homo sapiens
gtcattagtactcaatacagtttttgttgttatgaattgatccttgtaagaaatctaaagcaatgtgtgcttaaccgatgcttaaaactaatatgttattccccccaaatttttgcttatatgactattaataagctcagtttagaaactactgttctagaaaggaatatacttggtgttaatagttgttatgacccatcatcactagactgggctttttaaaaaaaagagagagagagagagatggggcctcagtatgttgcccaggctggactcctgggccaagtgatcctcctgcctcctaatagcgagactacaggcatatgctaccatgccaagctaaaatatttgagttttgattttgccgagtttttgatatgtggacaatagttgattagcttcgaaaagtgatagaattctacatctaaagtcatctttttt

SEQ ID NO: 276453 - DNA, 342 bp, Homo sapiens
tcctgcctgaccttgcacatttcaagacccttgtgatcacactgggccccagatcctcaggacactctctccatctgaaaaccagcagtggcatcctcccttctacctcgattccccttcatcatggggtagtggtgttcacaaaggaatcacaggtcccttcactctgtttctttggggtctttggccttcctcttctctttttccaagacgcctgcaaatatccaggaaactgggtctgtttctcatgtgacctgccaaatgtttctttccagttgacagcatccgtttacactttaccaacgatgtttgttgtttttgttgcagaagatttcagtttgt

SEQ ID NO: 276454 - DNA, 440 bp, Homo sapiens
ataactttgttccaacacattcaggctgcggtcagaaagggtgagctggaagcagtgagctgggagataatgaaaccaaaacaccattatcaggaagcttgagaacaaggccaccttttaagtatctagaaattcccattaatttcttccacaccttgttccccatcccacctgaagactgaagctgagaggcttttttcccagtcatcttgaccacaagatcagttctctccgtgaacataaagacaaaatcgctgtgacaccaacagacagattttttaacaagtggaatccatgtctcatgtaaacaatgtgctactgcctgccattgagttctcttccctcgttttcctttttgaagacttaacccctttcccaaagggacatgtgctcaggtttcttgactccacagcaatcccttctgttgtgtaaggcaaact

SEQ ID NO: 276455 - DNA, 195 bp, Homo sapiens
cagggaaaagcctctgaggagtagggctgggggaggctgtggcagggaccgtgtttcctgttcagaggctgtgctgagaaccgacttgaactcctggcctcaagtgatcaaccctcctcagcctcctaaagtgctggaattacaggtgtgagtcaccacgcacagctcaactttttttaaaaaaattaaaataac

SEQ ID NO: 276456 - DNA, 413 bp, Homo sapiens
ttaattagtatctctatcttccttctgtgtaataaaaagaatttagaatacttaacctccaatcgctcctctcatcctatataggtttttgtccatgttgttatctccaaattagtcatctctgttattactaaccctgtcggaaaataaatgcttgtttagacttagttacatgttaaccagttttgttttgttttgttttgttttgtttctgagtcccagttccactcttgttgcccaggctgaagtgcactggctgggtctcagctcactgcaacctctgcctcccaggttcaaggaattctcctgcctcagcctcccaagtaactgagattacaggcactcgccaccacaccctgctaatttttgtatttttagtagagatggggtttcaccacgttggccagtctgga

SEQ ID NO: 276457 - DNA, 699 bp, Homo sapiens
accactggactccagcctgggcaagagcaagactgtctcaaaacaaaaacaacaaacaaacaaacaaaaagaaaacacaaaaaacattactaaacaagatttctagagggaattaacaaaccagtgcttatttaccaataaactaatacgctaattgcaggaaccctgattaaagcaggcccctgttaacacaagattcttaggatatacttggaaacaggtgcattggaaaccactgtactgagaagtttatgggctcaagactgaattggaagctaggcgtggtcgctcatgcctgtaatcccagcactctgggaggctgaggtggaaggatgagttcaggagttcgagaccagcctgggcaacacagagagacgtgtctttaaaaaagtaaaaaatgggctgagtgccttggctcatgcctgtaatcccagcactttgggaagccaaggcgggtggatcacttcaggccaggagttcaagaacagcctgaccaacatggcaaaactccatctctactaaaaataccaaaaaattagcagggtgtggtggtgcacacctgtagtcccagctactcaggaggctgatgtgtgagaatcacttgaacctgggaggcggagtttgcagcgagccaagatcgtgccactgcactccagtgtgggcaacagagattctgtctcaaaaaaaaaaaaaaaagac

SEQ ID NO: 276458 - DNA, 333 bp, Homo sapiens
cacacagtagaggccatatatggcaagtctgcagctaacagcatactcaatactgaagagctaaaggctttttttctaatatcatgaacaatacaagatgcttacctattctcaccatttcttttgaacatagttctggaagtcctagccagagcaattagacaagagaaagaaataaaaggcatcctaataggaaaggatgaagtgaaattatctttgtttgctgactacatgatcttatacagttacacctctgtatctgtgggttctgcatctttggattcaaccaaccacagattgaaaatactcagaaaaaaatggatagttatgcct

SEQ ID NO: 276459 - DNA, 473 bp, Homo sapiens
agaggccacaggatgtgcctacaatcacagagctggaggcaaaacccagcagaaccaagtcagcccagtggccttcctaccgattcaccatggcctttggaccggcccatactcagtctattttaagtaatgccaagaagtgtctctatgtatcccccagcagtattcatgcccaaccagccaggacactcagggttccccaatttactattagggagcctacttcggcagcagggagagtggtactttgggacaggttggggctggcagggcaggctgacagaggtgctgagcaggaaagcatgcaggaggaaaatcctgcaggggtgtctgtttcacaagagttacaagaatacaggaccattccttctaccaaggaggctagtggttcgagatcctagaaaactaggactccgcctttaccaagaataaacaacagcttctccttccccaaattgcaaaaacaaacaaac

SEQ ID NO: 276460 - DNA, 200 bp, Homo sapiens
cccttttctgctctgttccatccaggctcccccagacaggccatgttggcttatgggtatggggtgctaagaggacttagcctgctcaagtgccttcaggagagagagccatcatggccaaggtgccagaacccctgtctgtggatatttaccctggagaaacctggagaccagggtctgtgcctccatccatttgatca

SEQ ID NO: 276461 - DNA, 322 bp, Homo sapiens
gaacattctctccctgaaggcagagatgttcatctatcttattgtggctgtgtccccacacagtaggtgctcagtaagggcccaagtgtcccagctgcctcgtcctgagtataggatttagcctctctatgccaaagtttctccatacgtcagaagggggaaataaaatgagctgacctcacagaatcattgagggataaatcctagctactcaggaggctgaggtgggaggattgcttgagcccaggaggtggagactgcagtgagtcataatcataccactgcaccccagcctgggctacagagccagaccctgcctcaa

SEQ ID NO: 276462 - DNA, 355 bp, Homo sapiens
tgcggccgcgccccgcccccagctccccgcacgctgcccctcccgctcgtctgtcccgctggcggcccagcgtgctggctgtacgcgtcacttccggctgtgtcggcgcgcgaaaaaaggaaccaaagagaagtgaaggaatgtgtccaagggctcccaagttggcggtggaattagaattgaagcctcagctccaaagcctgtgttctgaactacccggttgcagttcacaaaatacactttggcagtactttcataacgaaaacaaatgattacaaccagtttacaaatgctttgctttactggaggatcgacatgtttgactaattttcaaaaataaatctcagaagcagca

SEQ ID NO: 276463 - DNA, 491 bp, Homo sapiens
gcctcgcgtgccgattttcatagttccctgtggctccgagccgagggagccgcggtgtggaacggagggaaccagtgatctcagtgctgaagaaaacagggagtgtgtgtcttcatacttgatttgccttaccgcaggggcataatatgagatatctgggcgtgttaagtcgttcttgatgaaatgtgtcctctgtgaatgtagtctcactgttagactaggaagatgctgttttgctgtgcccagttcctcttaaaagtacagatgctccttgggttgcagccgtaataaacccatcctaaatagaaaacgcgttttaatacccttataaacgaaaaggataaataagcctttgggttctgtaatgtgagccagcattctttgagtgcgtatgtgacaggtaaatgttttacgtatattaaactcatttaatgttcataagttctaagtgcatcgctacaattattacaaatgaatcccattttacacag

SEQ ID NO: 276464 - DNA, 908 bp, Homo sapiens
tgcggccgcgccccgcccccagctccccgcacgctgcccctcccgctcgtctgtcccgctggcggcccagcgtgctggctgtacgcgtcacttccggctgtgtcggcgcgcgaaaaaaggtcctgggttggaatgtttgtactggtctgtggcggtggttgtcggctgtcctgccaggaaaactcggcactgactatcccactgctgatgctgtaaaagaggtccttctgctatgacgcaactgtggttcctctggttctggggacacttaggcctcgcgtgccgattttcatagttccctgtggctccgagccgagggagccgcggtgtggaacggagggaaccagtgatctcagtgctgaagaaaacagggagtgtgtgtcttcatacttgatttgccttaccgcaggggcataatatgagatatctgggcgtgttaagtcgttcttgatgaaatgtgtcctctgtgaatgtagtctcactgttagactaggaagatgctgttttgctgtgcccagttcctcttaaaagtacagatgctccttgggttgcagccgtaataaacccatcctaaatagaaaacgcgttttaatacccttataaacgaaaaggataaataagcctttgggttctgtaatgtgagccagcattctttgagtgcgtatgtgacaggaaccaaagagaagtgaaggaatgtgtccaagggctcccaagttggcggtggaattagaattgaagcctcagctccaaagcctgtgttctgaactacccggttgcagttcacaaaatacactttggcagtactttcataacgaaaacaaatgattacaaccagtttacaaatgctttgctttactggaggatcgacatgtttgactaattttcaaaaataaatctcagaagcagca

SEQ ID NO: 276465 - DNA, 781 bp, Homo sapiens
tcagtttgaatgattgtggtttaaaccaggataggagcaaaaaacacttctttgaattggataaataatctatgcattcagtcataaattaaatatgattaactccctttcttggtatgtcctgtatattgatctatccagcatccaaaactgttatctaccttacatagtggtacgtttgaggcattccatttacctacagtttccattgagccaatgtatgggtttcagtaggttccttaatgatgtaacattgtcaatttttaatgatgttatgttgttatgtatagaagtccagtctccatcatctgaatcaaaccaaaggatttaattacagagtgaatctgggaccttacctaagttagatctagtaccattaaggctttctatgcatacagataagtcaccagtaataaaacttagagtaactagaagctatcccatggcttccagtgcttcttcccaatgccaaaccagctggccatgagtattagtcagatgacttatgttaaacctttttgtaaagtcattttcctgaatgggtcaacaaatcatatataggagctggttctagcattaattgcaattcttcccaagtgtttgtttgtttgtttgtttgtttgtttgttttaacagagacagggtctagctctgttgcccaagctggaatgctgtggtgggatcatagctcactgcaacctccaacttctaggctcaagtgatcctcttgcctcagcctcgcggactacaggtgcctgcaaccatttctggctatttaaaa

SEQ ID NO: 276466 - DNA, 443 bp, Homo sapiens
gggaggaaggcaggggaggggaagagagagaactataaaaagtaaagaatccaaatatccagtatcaaaacaaggacaggaatagtttgtggacatcccattagaacacaatatactattcataagttttataaagtcacttactttgccttccagaatcaatcatgttagttactacttaagcctttcttagttttattttcctttcgtaaattatatagtcttatcagaaggacttaaacactgttaagtgtttcaaaagatgctatttagttatttttaaatccttatgacatctgaataaatgtttcttccattgaaggtgaaaacatttactgtttgcccatagataaaaatgggcaaaatattggcattattagattatattattttttcttttcattgttttttattgatttctatcctagagaaacaaaacaaac

SEQ ID NO: 276467 - DNA, 291 bp, Homo sapiens
aaagacttgaatttggttattagaagtttattagtgacatctgggtatacagctcgagttagaggaagaagccaattatagagggttaaagagaacatagatgctgtgtgcttttctcagtatgtttttgttacaaagattgttctgcagggacatcacttaaatcacatataacagtatcttgtatccctagttgtgatgatgccatagatgtcttgtttctacttctctttggcttcacggtattaagcatgtagtagatgtgttgaaaataataactgtgtgagtaaa

SEQ ID NO: 276468 - DNA, 307 bp, Homo sapiens
aaagacttgaatttggttattagaagtttattagtgacatctgggtatacagctcgagttagaggaagaagccaattatagagggttaaagagaacatagatgctgtgtgcttttctcagtatgtttttgttacaaagattgttctgcagggacatcacttaaatcacatataacagtatcttgtatccctagttgcgactccttgacgttgacaatcgagtagtactcccgattgaggccccattcgtataataatacatcacagacgtctgcactcatgagctgtcccacataggctaaaacaga

SEQ ID NO: 276469 - DNA, 410 bp, Homo sapiens
tgatgatcccttgcattcacttaatgaatggtaaacatattttctcttccttataattttcttagtaacattttccttttgctagtttactgtaagactacagtattaatacttatgacatataaaatacatgttaatagactgtttatcttatcagtaagacttccaatcaacaagaggctatcagtagttaagttttgagggagtcaaaattataaatagatttttgactgtggtgaggagagtcgacacccttaagccccatattattcaaagtcacctgtatttcagtatcctgcccaaataggaatccctctgccaaatgaccaaacagcctttccttgaaaatgtagaaagtcagagactcctcacttcacaaaataaactcattctgctgttgggaaatttac

SEQ ID NO: 276470 - DNA, 327 bp, Homo sapiens
ggcaggagtgtcgcttgagcccagatgtttgaggttgcaataagctatgaccatgccactgcactctagtctgggtgacagagggagaccctgtttcttaaaaaataaaataacagataccctcaactaaacttggtgtggccatgacagtgaccttgatcttaggttatttaacatttacgacttttatctcttagtcccatcaagccttcaagaactatttctgaatgtaatctcatgtcagctagggaaatcatactccagtggaaaagctttggagtcaaatcttgagtccaaatttctgtgcaaccacatgttaataatgcg

SEQ ID NO: 276471 - DNA, 1161 bp, Homo sapiens
cgcaattttattgtattttatttttttagagacagggtcttgctgtttcccccaggctggagtgcaatggagtgatcatagctcacttcagcctccaactcctgggctcaagcgatcctcccacctcagcctcccccgtagctgggactacaggcatatgccaccatgcccggcttctcagagctgcaattttaaattgggagccagggaagacctccctgtggaggtggcaggttatcaagactgaagatgtagagaagaaccttccagtcaaagggaaaaggcaggtcctgctgtgctcaggaatggccagaagtactatcatccatccccatcttagagatgtggacagggccgcaacagtgtcagggcgtttcctggctcctcaacagcaggatccgaagtcgtctggaggatgtgccgctctgcttggggcggacctcccctggagcgcacctcccctggagcgcgcgacgcgcagggtgcacacagccctcttggaccccgggaccggctcaggctcaggctcggcgtcagcaaagggacctgcgcggcgccctggggcggaggaggcccgacggtcagtggccagtgccgtgcggctgacggaggtcggggcgcaacgggaccgggaggagcgcccagggcgggggtgccaggccccctccaaccgcggcggggttggagtcaaggcggctccgggcgggggtcggaccccaaatccaggccacaggccgccgcccggtcttcttctttacccgaagggcggccgcggcggatgggaagccgtgcacgacgagcacaatctccatggggaggagaacaggaatgttcctgtgagccccgccgcgccctaccgccagcgcagcccagcatcgcgggtcccctcctatcccaccggagaacggggtcctcactcccagcttcagccgagccctggccccgcaactgcctgaaggcacgccccctgcacctgcccacctcaggtcccgcctccagcccaggtacccacctgttctcattcctctccctcctgcgctccacccgaccccagcgtgccccccaagacccctgcgctggaccccagcctggatcatcaccctcgcctcagccagctgctctccggagttctcgagtcatcgctgttccagacagcgatga

SEQ ID NO: 276472 - DNA, 1270 bp, Homo sapiens
ttccgcctcctccagggagccttcctccgggcacagagaccctccccctcttaacagggacctcggccaatggtccgccaagccccgccttttttgcggccaccattgtgctgctggacgaacagggttgacagtgagccccacgtagacagggcccgggtaccagggattcaggcagtagagcagctggacgctgaagaggcacccggcctcgccccgattcccgcgggacccttcgaattttaggaacttttcactaacgaaacacacttctgtgtcagcaccgacatcaagaagagaacctcaccagcacctcagaacccgctttgtccctccctggttccttcccctgggtgcctggtgtgctgccgtctcacccatatgtagttgagcgcagcagcccctgtaggacacctggcagatcaggtcacagtcctgctgtgccctcgggctcactcgggagctgggggctcccaggtgctcctccagcagctcagttcagcatgctggggggtcagggccagcccctgtccctggggcctcaggcctccctttcttcccacagtggccaagatcgcgggtctctacaatgacttggagccaccccggaagaccatgcgcagaggggtgctgatgaccctgctgcagcagtcggccatgaccctgcccctgtggattgggaagcctggtgacaagcccccacccctctgtggggccatccctgcctcaggagactacgtggccagacctggagacaaggtggctgcccgggtgaaggccgtggatggggatgagcagtggatcctggccgaggtggtcagttacagccatgccaccaacaagtgagtgacaccagccccggggctgctctctgcccttcctgtccacctgccccacagccccaggaggactattctatcctgtttgaagacacctcctatgcagacggctactcccctcatctcagtgtggcccagaggtacctggtagcttctaaggagcccaagaaaaagtgacgctgcccggcggactcgacgtcctccaccatcttggggcaggacagcagaggatgtgctgggattaaacagacatcccccctccacacatctcctgggttttacttctccaaacccttctcccctccccagatatggtgacctggggagctgaaggctgggggagaggtgaccatatgtggccccaccgggcattcactctttcagctcagagtttctcttcctttccaatacaggctctacatgaacacaaa

SEQ ID NO: 276473 - DNA, 1621 bp, Homo sapiens
cgcaattttattgtattttatttttttagagacagggtcttgctgtttcccccaggctggagtgcaatggagtgatcatagctcacttcagcctccaactcctgggctcaagcgatcctcccacctcagcctcccccgtagctgggactacaggcatatgccaccatgcccggcttctcagagctgcaattttaaattgggagccagggaagacctccctgtggaggtggcaggttatcaagactgaagatgtagagaagaaccttccagtcaaagggaaaaggcaggtcctgctgtgctcaggaatggccagaagtactatcatccatccccatcttagagatgtggacagggccgcaacagtgtcagggcgtttcctggctcctcaacagcaggatccgaagtcgtctggaggatgtgccgctctgcttggggcggacctcccctggagcgcacctcccctggagcgcgcgacgcgcagggtgcacacagccctcttggaccccgggaccggctcaggctcaggctcggcgtcagcaaagggacctgcgcggcgccctggggcggaggaggcccgacggtcagtggccagtgccgtgcggctgacggaggtcggggcgcaacgggaccgggaggagcgcccagggcgggggtgccaggccccctccaaccgcggcggggttggagtcaaggcggctccgggcgggggtcggaccccaaatccaggccacaggccgccgcccggtcttcttctttacccgaagggcggccgcggcggatgggaagccgtgcacgacgagcacaatctccatggggaggagaacaggaatgttcctgtgagccccgccgcgccctaccgccagcgcagcccagcatcgcgggtcccctcctatcccaccggagaacggggtcctcactcccagcttcagccgagccctggccccgcaactgcctgaaggcacgccccctgcacctgcccacctcaggtcccgcctccagcccagtggccaagatcgcgggtctctacaatgacttggagccaccccggaagaccatgcgcagaggggtgctgatgaccctgctgcagcagtcggccatgaccctgcccctgtggattgggaagcctggtgacaagcccccacccctctgtggggccatccctgcctcaggagactacgtggccagacctggagacaaggtggctgcccgggtgaaggccgtggatggggatgagcagtggatcctggccgaggtggtcagttacagccatgccaccaacaaacacctcctatgcagacggctactcccctcatctcagtgtggcccagaggtacctggtagcttctaaggagcccaagaaaaagtgacgctgcccggcggactcgacgtcctccaccatcttggggcaggacagcagaggatgtgctgggattaaacagacatcccccctccacacatctcctgggttttacttctccaaacccttctcccctccccagatatggtgacctggggagctgaaggctgggggagaggtgaccatatgtggccccaccgggcattcactctttcagctcagagtttctcttcctttccaatacaggctctacatgaacacaaa

SEQ ID NO: 276474 - DNA, 1235 bp, Homo sapiens
ttccgcctcctccagggagccttcctccgggcacagagaccctccccctcttaacagggacctcggccaatggtccgccaagccccgccttttttgcggccaccattgtgctgctggacgaacagggttgacagtgagccccacgtagacagggcccgggtaccagggattcaggcagtagagcagctggacgctgaagaggcacccggcctcgccccgattcccgcgggacccttcgaattttaggaacttttcactaacgaaacacacttctgtgtcagcaccgacatcaagaagagaacctcaccagcacctcagaacccgctttgtccctccctggttccttcccctgggtgcctggtgtgctgccgtctcacccatatgtagttgagcgcagcagcccctgtaggacacctggcagatcaggtcacagtcctgctgtgccctcgggctcactcgggagctgggggctcccaggtgctcctccagcagctcagttcagcatgctggggggtcagggccagcccctgtccctggggcctcaggcctccctttcttcccacagtggccaagatcgcgggtctctacaatgacttggagccaccccggaagaccatgcgcagaggggtgctgatgaccctgctgcagcagtcggccatgaccctgcccctgtggattgggaagcctggtgacaagagactacgtggccagacctggagacaaggtggctgcccgggtgaaggccgtggatggggatgagcagtggatcctggccgaggtggtcagttacagccatgccaccaacaagtgagtgacaccagccccggggctgctctctgcccttcctgtccacctgccccacagccccaggaggactattctatcctgtttgaagacacctcctatgcagacggctactcccctcatctcagtgtggcccagaggtacctggtagcttctaaggagcccaagaaaaagtgacgctgcccggcggactcgacgtcctccaccatcttggggcaggacagcagaggatgtgctgggattaaacagacatcccccctccacacatctcctgggttttacttctccaaacccttctcccctccccagatatggtgacctggggagctgaaggctgggggagaggtgaccatatgtggccccaccgggcattcactctttcagctcagagtttctcttcctttccaatacaggctctacatgaacacaaa

SEQ ID NO: 276475 - DNA, 1674 bp, Homo sapiens
cgcaattttattgtattttatttttttagagacagggtcttgctgtttcccccaggctggagtgcaatggagtgatcatagctcacttcagcctccaactcctgggctcaagcgatcctcccacctcagcctcccccgtagctgggactacaggcatatgccaccatgcccggcttctcagagctgcaattttaaattgggagccagggaagacctccctgtggaggtggcaggttatcaagactgaagatgtagagaagaaccttccagtcaaagggaaaaggcaggtcctgctgtgctcaggaatggccagaagtactatcatccatccccatcttagagatgtggacagggccgcaacagtgtcagggcgtttcctggctcctcaacagcaggatccgaagtcgtctggaggatgtgccgctctgcttggggcggacctcccctggagcgcacctcccctggagcgcgcgacgcgcagggtgcacacagccctcttggaccccgggaccggctcaggctcaggctcggcgtcagcaaagggacctgcgcggcgccctggggcggaggaggcccgacggtcagtggccagtgccgtgcggctgacggaggtcggggcgcaacgggaccgggaggagcgcccagggcgggggtgccaggccccctccaaccgcggcggggttggagtcaaggcggctccgggcgggggtcggaccccaaatccaggccacaggccgccgcccggtcttcttctttacccgaagggcggccgcggcggatgggaagccgtgcacgacgagcacaatctccatggggaggagaacaggaatgttcctgtgagccccgccgcgccctaccgccagcgcagcccagcatcgcgggtcccctcctatcccaccggagaacggggtcctcactcccagcttcagccgagccctggccccgcaactgcctgaaggcacgccccctgcacctgcccacctcaggtcccgcctccagcccagtggccaagatcgcgggtctctacaatgacttggagccaccccggaagaccatgcgcagaggggtgctgatgaccctgctgcagcagtcggccatgaccctgcccctgtggattgggaagcctggtgacaagagactacgtggccagacctggagacaaggtggctgcccgggtgaaggccgtggatggggatgagcagtggatcctggccgaggtggtcagttacagccatgccaccaacaagtgagtgacaccagccccggggctgctctctgcccttcctgtccacctgccccacagccccaggaggactattctatcctgtttgaagacacctcctatgcagacggctactcccctcatctcagtgtggcccagaggtacctggtagcttctaaggagcccaagaaaaagtgacgctgcccggcggactcgacgtcctccaccatcttggggcaggacagcagaggatgtgctgggattaaacagacatcccccctccacacatctcctgggttttacttctccaaacccttctcccctccccagatatggtgacctggggagctgaaggctgggggagaggtgaccatatgtggccccaccgggcattcactctttcagctcagagtttctcttcctttccaatacaggctctacatgaacacaaa

SEQ ID NO: 276476 - DNA, 1709 bp, Homo sapiens
cgcaattttattgtattttatttttttagagacagggtcttgctgtttcccccaggctggagtgcaatggagtgatcatagctcacttcagcctccaactcctgggctcaagcgatcctcccacctcagcctcccccgtagctgggactacaggcatatgccaccatgcccggcttctcagagctgcaattttaaattgggagccagggaagacctccctgtggaggtggcaggttatcaagactgaagatgtagagaagaaccttccagtcaaagggaaaaggcaggtcctgctgtgctcaggaatggccagaagtactatcatccatccccatcttagagatgtggacagggccgcaacagtgtcagggcgtttcctggctcctcaacagcaggatccgaagtcgtctggaggatgtgccgctctgcttggggcggacctcccctggagcgcacctcccctggagcgcgcgacgcgcagggtgcacacagccctcttggaccccgggaccggctcaggctcaggctcggcgtcagcaaagggacctgcgcggcgccctggggcggaggaggcccgacggtcagtggccagtgccgtgcggctgacggaggtcggggcgcaacgggaccgggaggagcgcccagggcgggggtgccaggccccctccaaccgcggcggggttggagtcaaggcggctccgggcgggggtcggaccccaaatccaggccacaggccgccgcccggtcttcttctttacccgaagggcggccgcggcggatgggaagccgtgcacgacgagcacaatctccatggggaggagaacaggaatgttcctgtgagccccgccgcgccctaccgccagcgcagcccagcatcgcgggtcccctcctatcccaccggagaacggggtcctcactcccagcttcagccgagccctggccccgcaactgcctgaaggcacgccccctgcacctgcccacctcaggtcccgcctccagcccagtggccaagatcgcgggtctctacaatgacttggagccaccccggaagaccatgcgcagaggggtgctgatgaccctgctgcagcagtcggccatgaccctgcccctgtggattgggaagcctggtgacaagcccccacccctctgtggggccatccctgcctcaggagactacgtggccagacctggagacaaggtggctgcccgggtgaaggccgtggatggggatgagcagtggatcctggccgaggtggtcagttacagccatgccaccaacaagtgagtgacaccagccccggggctgctctctgcccttcctgtccacctgccccacagccccaggaggactattctatcctgtttgaagacacctcctatgcagacggctactcccctcatctcagtgtggcccagaggtacctggtagcttctaaggagcccaagaaaaagtgacgctgcccggcggactcgacgtcctccaccatcttggggcaggacagcagaggatgtgctgggattaaacagacatcccccctccacacatctcctgggttttacttctccaaacccttctcccctccccagatatggtgacctggggagctgaaggctgggggagaggtgaccatatgtggccccaccgggcattcactctttcagctcagagtttctcttcctttccaatacaggctctacatgaacacaaa

SEQ ID NO: 276477 - DNA, 435 bp, Homo sapiens
gagaccaaacgtttaataattgtcttctattctaaaacttgtctctcagcaacaacagcagcaattacttttgaccactcactatcggaaaacactgctttaggctgtggaaatgcagtagtagaaaagccaggcataatccttatccccatggaggcactatctccatccaagggcagaggacctgcaagccctgaggtctccagctgaggttcctctctgaaggacagttgcacttcaggtcatgctgcagtatgagagaaggcagcgtgacatcttaagtttctaatgctcacacctgtctcagtgaagcatttttacagagtaatcaccacccccctcacacccccaacaatgtcatcaagtcataaatctccttggtttgaaatattggattaaaatatgattaaacaatatgtctcaatggaaagttaa

SEQ ID NO: 276478 - DNA, 431 bp, Homo sapiens
taacaaactggctttaggatcacgtgcagtggactttttatttaagaaaatagaagtgaaaattttactatgaacatttcctaagcaaagatttttcttttaaacaagtatcacaaatatttgtgggattagaaaataatcccccccacacacacacaaacacacacatagcaaacttatataattggaaaagtatatttatctcttcctaatacttcaatgctagaaaaatattttactttaacatttatttaaaagcaatactatattctgttaaagtggtaaactgataatttcaataattgcttcaaataaaattttaaaaatgttttaattgtgataaaatacacgtgacataaatttaccatcttaacgatttttaagtgtacagttcaccagggttaagtgtattcactttgttttacaaccaa

SEQ ID NO: 276479 - DNA, 188 bp, Homo sapiens
aataatacatggtttatctgtctcacaaatttattattgggatcaaaactttacatacacaaaagcattttccaaactctaacagagcccagggaaggagagagagctcaagctaggaaatgtaatatagatgctcaatagcagtctttatatactgtgacagtcttcattaaaagcaatatataata

SEQ ID NO: 276480 - DNA, 182 bp, Homo sapiens
  misc_feature (175)..(175): n is a, c, g, or t
gaaattttaacagcaacaaagaaagtaaaacatggaatagcattttccccctgaaggtgcagggaaaaaagtaactgaacaattaaaatcctctatctactaaatatcttaaaaaagagggaagataagtgtttttcatttgtttacttccaacagagtgaggcttaaataattnttttttt

SEQ ID NO: 276481 - DNA, 297 bp, Homo sapiens
agattatgtgcttttccgtgctgcagaccggaagactgatttgatttcctgaatgaggaaggctccttgcccttccctgaattgaggggatggctttgctcagccaagggagaagacgggcaaagaggacatccggaggacagaggaaggtggaagtggaactgaagaagcagcatgctgcttgctgacagggaaggcacacaggcttggcatcaggcgagcaaggcagaagccctggttcagatattataacagaaccaaggccaagttactgtgcctcttagagtctcagtttcc

SEQ ID NO: 276482 - DNA, 456 bp, Homo sapiens
taatgtatttggaaccttgggctgtatcttcacgtacatactgggttggaagaaggagccaccaagtggcaatgactgcacttggtgacgagagaactcagcaactagtcacaatctaggtcattaaaatgtcctttaaatgtctccgtttaatccatttttccgttttcaaacctgtttacatgtcgaattttcttgtctcttttatgtaggatttgtaattcaggtaaatctgagtttttcttatttcttttctccttcatacaatgatatttttataaatgtggattacgacaaggcttaaggcagcttattagatattgtgtgtaaaggaggatctgctttttccatcgattccattgaattctcacactatcatccataaaattcttccattttttacatattataaccatatttaaaaagttatttctatggataatactttcaaaaaat

SEQ ID NO: 276483 - DNA, 1933 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (8)..(8): n is a, c, g, or t
nccntncnagccctaataaaactctgagactattttctatcacaatgacagctgatgaatttaatgtgcctcacaaactataggaattgtgataggaagttgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacatttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaa

SEQ ID NO: 276484 - DNA, 5440 bp, Homo sapiens
  misc_feature (191)..(191): n is a, c, g, or t
aggagagggagtggggaggccgaaccggagagaagcaggaagtagcggcggccgcggggagggcggcggtggctgcagcggctggagcggggtagagaccgccgggtctcggcccgcaccaggagcggaacaacctttcagatctgtgtggaccccagaagatccgtgaagaatatgaattgattccatgnggacatgaatgagtccttaaacctagaacatcatgtacatcatcctccttaataatagtattgattatttggttctatgctggggaccggaggggatgagatggtttccaccagaatgctcactgagctctattacccttccctgttccctgtattttttttttttttctgagacagtcttgctctgtcgcccaggtgggagtgcagtggcacgatctcagctcactgcaaactccacctcccaggttcaagcaattcttctgcctcagcctcccgagtagctgggactacaggtgtgtgctgccatgcccagctaatttttgtatttttagtagagacggggtttcactatcttggccaggatggtcttgatctcctgacctcgtgatccgcccgcctctgcctccccaagtgctgggattacaggcgtgagccaccatgcccagccccctatatttcttttttttgagacagggtctcgctctgtccaggctggagtgcagtggcgtgatcttggctcattgaaacctcaacctcatgggttcaggcgattctcctgcctcagcctcctttgtagctgcgattacaggcatgtgccaccacacctgtctagttttttgtatttttagtagagacaaggtttcaccatgttggccaagctggtctcaaactcctgacctcaagtgatccatctgcctcagcctcccaaaacgctgggattacaagcatgagccaccgcacctggccccttccctgtatttctaagaactctcttttcccctgctttctctggattttggagcccaccaaggtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccccactctcctgctcctcccagtgggggcacctggaaagaaaaaggcatggaaggcaaaactcccttggacctgtttgctcattttggccctgagccaggggaccactcagatccgctgcctccctctgcaccctctcccactcgggagggggctctgaccccgcctcctttcccctcttcctttgagctggcccaggagaatggcccaggcatgcagccacctgtttcttccccaccattgggggccttgaagcaggagagctgcagcccccatcatccccaggtcctagcccaacaaggctcaggctccagccctaaggccacggacatccctgccagtgcctcgcctcccccagttgctggggtgcccttcttcaagcagtctccagggcaccagagccctcttgcctcccccaaagtgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcacaaggactgtaactcaggtcccctcagatcctgatccacctgcccccttggctgagggggccttcttggctgaggctagcctcttgaagctgtcccctgcaacacctacttctgagggtccaaaggtggtgagcgtacagttgggtgatggtacaaggctgaaaggcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagtgcagcctgctcctgcatgcacgtgaacacaaggacaaggggctcgtcatgcagtgctcacatttggtcatgaggcctgtagcccttgaccagatggtggggcagccggacatcacaccgctgctgcctgtagctgtcccacctgtctctggacctctggccttgcctgccttgggcaagggtgagggggccatcacctcctctgccattactacagttgctgctgaggcccctgtcctgccgctctccacagagccgcctgctgccccggccacctctgcttacacatgctttcgctgcctggagtgcaaggaacagtgccgggacaaggctggcatggcagctcacttccagcagctcggcccccctgcccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacaggtgccccagctgttcagtggtgtttgggggtgtgaactccatcaagtcccacatccagacgtcgcactgcgaggttttccacaagtgccccatctgccccatggccttcaagtctgggccaagtgcccatgcccacctctactcccagcatcccagcttccaaactcagcaggccaagctgatctacaagtgcgccatgtgcgacacagtcttcactcacaaacccctcctctcctcacacttcgaccagcacttgctgccccagcgtgtcagtgtctttaagtgcccgtcttgtcctctgctctttgcccaaaaaaggaccatgctggaacatctcaagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattagtattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctccaaaaaaaaaaat

SEQ ID NO: 276485 - DNA, 4632 bp, Homo sapiens
aggagagggagtggggaggccgaaccggagagaagcaggaagtagcggcggccgcggggagggcggcggtggctgcagcggctggagcggggtagagaccgccgggtctcggcccgcaccaggagcggaacaagtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccccactctcctgctcctcccagtgggggcacctggaaagaaaaaggcatggaaggcaaaactcccttggacctgtttgctcattttggccctgagccaggggaccactcagatccgctgcctccctctgcaccctctcccactcgggagggggctctgaccccgcctcctttcccctcttcctttgagctggcccaggagaatggcccaggcatgcagccacctgtttcttccccaccattgggggccttgaagcaggagagctgcagcccccatcatccccaggtcctagcccaacaaggctcaggctccagccctaaggccacggacatccctgccagtgcctcgcctcccccagttgctggggtgcccttcttcaagcagtctccagggcaccagagccctcttgcctcccccaaagtgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcacaaggactgtaactcaggtcccctcagatcctgatccacctgcccccttggctgagggggccttcttggctgaggctagcctcttgaagctgtcccctgcaacacctacttctgagggtccaaaggtggtgagcgtacagttgggtgatggtacaaggctgaaaggcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagtgcagcctgctcctgcatgcacgtgaacacaaggacaaggggctcgtcatgcagtgctcacatttggtcatgaggcctgtagcccttgaccagatggtggggcagccggacatcacaccgctgctgcctgtagctgtcccacctgtctctggacctctggccttgcctgccttgggcaagggtgagggggccatcacctcctctgccattactacagttgctgctgaggcccctgtcctgccgctctccacagagccgcctgctgccccggccacctctgcttacacatgctttcgctgcctggagtgcaaggaacagtgccgggacaaggctggcatggcagctcacttccagcagctcggcccccctgcccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacaggtgccccagctgttcagtggtgtttgggggtgtgaactccatcaagtcccacatccagacgtcgcactgcgaggttttccacaagtgccccatctgccccatggccttcaagtctgggccaagtgcccatgcccacctctactcccagcatcccagcttccaaactcagcaggccaagctgatctacaagtgcgccatgtgcgacacagtcttcactcacaaacccctcctctcctcacacttcgaccagcacttgctgccccagcgtgtcagtgtctttaagtgcccgtcttgtcctctgctctttgcccaaaaaaggaccatgctggaacatctcaagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcagaagcaagggccctggccttcgggctgtgccgctgctgccatcctgtcctctcccatttcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattagtattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctccaaaaaaaaaaat

SEQ ID NO: 276486 - DNA, 2430 bp, Homo sapiens
gcttccaaactcagcaggccaagctgatctacaagtgcgccatgtgcgacacagtcttcactcacaaacccctcctctcctcacacttcgaccagcacttgcttgccctggggccaccagcaatgtgtgcccaacctgccccatgatgctccccaatcgctgcagcttcagcgcccaccagcgcatgcataagaatcgacccccccatgtctgtcctgagtgtgggggcaacttcctgcaagccaattttcagacccatctccgggaggcctgtctgcacgtctctcgccgtgtaggatacaggtgccccagctgttcagtggtgtttgggggtgtgaactccatcaagtcccacatccagacgtcgcactgcgaggttttccacaagtgccccatctgccccatggccttcaagtctgggccaagtgcccatgcccacctctactcccagcatcccagcttccaaactcagcaggccaagctgatctacaagtgcgccatgtgcgacacagtcttcactcacaaacccctcctctcctcacacttcgaccagcacttgctgccccagcgtgtcagtgtctttaagtgcccgtcttgtcctctgctctttgcccaaaaaaggaccatgctggaacatctcaagaacacccatcagtctgggcgcttggaggagactgctgggaaaggggccgggggtgccctgctgacccccaagactgagcctgaggagctggctgtttctcagggaggggcagcccctgctactgaggagtcgtcttcatcttcagaagaggaggaagtacccagctcccctgagcccccccgtccagccaaacggcctcggcgggaactagggagcaaaggcctcaagggtgggggtggggggcctggaggctggacctgtggcctgtgtcactcctggttccctgagcgtgatgaatacgtggcccacatgaagaaggagcatggcaagtcagtgaaaaagttcccctgtcgcctgtgtgagcgctccttctgctccgcccccagcctgaggcgccatgtcagagttaatcacgagggcatcaagcgagtttacccctgcaggtattgcacagagggaaaacgcaccttcagcagccgcctgatcctagagaaacatgtccaggtccggcacggcttgcagcttggggcccagtcccctggccgggggaccaccttggctcggggttccagtgccagagcccaggggccaggtcggaaacgccgccagtcttctgactcttgcagtgaggagcctgacagcacgacaccgccagccaagtcccccaggggcggacctggatctggaggccatggccctctgcgctaccggagcagcagctccacagaacagagcctcatgatggggttgagggtggaggatggtgcccagcagtgcctcgactgtggcttgtgctttgcctcccctggctccctgagccgacaccgtttcatcagccacaagaagagacggggtgtgggtaaagccagtgccctggggctgggggatggggaggaagaggcccctccatcaaggtctgaccccgatggtggagactcacccctgcctgcttctggaggcccactgacctgtaaggtctgtggcaagagctgcgacagccctctaaacctcaagacccacttccgcacgcatggcatggcgttcatcagggctcggcagggggctgttggggacaactagtctccaaggcctgggactgaccagccccttcctcttggagcctggttttccctactgctgcctgatccctcggctggggagttttcattaacattagtattttgttaattcctgtctctccaacctgaagaagaagagcatttgaggattattctagttatttgcaacctccctttgggtttggccctggagtcctagtagagtggaccctccattcctcctttctgagcccaacactaattaattttatgctcctgctgcagaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctccaaaaaaaaaaat

SEQ ID NO: 276487 - DNA, 1179 bp, Homo sapiens
aggagagggagtggggaggccgaaccggagagaagcaggaagtagcggcggccgcggggagggcggcggtggctgcagcggctggagcggggtagagaccgccgggtctcggcccgcaccaggagcggaacaagtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccccactctcctgctcctcccagtgggggcacctggaaagaaaaaggcatggaaggcaaaactcccttggacctgtttgctcattttggccctgagccaggggaccactcagatccgctgcctccctctgcaccctctcccactcgggagggggctctgaccccgcctcctttcccctcttcctttgagctggcccaggagaatggcccaggcatgcagccacctgtttcttccccaccattgggggccttgaagcaggagagctgcagcccccatcatccccaggtcctagcccaacaaggctcaggctccagccctaaggccacggacatccctgccagtgcctcgcctcccccagttgctggggtgcccttcttcaagcagtctccagggcaccagagccctcttgcctcccccaaagtgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcaca

SEQ ID NO: 276488 - DNA, 1417 bp, Homo sapiens
aggagagggagtggggaggccgaaccggagagaagcaggaagtagcggcggccgcggggagggcggcggtggctgcagcggctggagcggggtagagaccgccgggtctcggcccgcaccaggagcggaacaagtctgggatctgccgatatgggggatatgaagacccctgattttgatgacctccttgctgcctttgacatccctgacattgatgcgaatgaagccatccattctgggccagaagaaaatgaggggcctggaggcccagggaagccagaaccaggtgtaggaagtgaatctgaagacacagcagcagcctctgctggggatggccctggagttccagcccaggcctctgaccatggcctgccaccgccagacatttctgtagtcagtgtcattgtcaagaacactgtgtgtcccgagcagtctgaggccctggctggaggctcagcaggagacggggcccaggctgctggggtaactaaagaagggcctgtggggcctcatcgaatgcagaatggttttgggagccctgaaccttccctcccaggaactccccactctcctgctcctcccagtgggggcacctggaaagaaaaaggcatggaaggcaaaactcccttggacctgtttgctcattttggccctgagccaggggaccactcagatccgctgcctccctctgcaccctctcccactcgggagggggctctgaccccgcctcctttcccctcttcctttgagctggcccaggagaatggcccaggcatgcagccacctgtttcttccccaccattgggggccttgaagcaggagagctgcagcccccatcatccccaggtcctagcccaacaaggctcaggctccagccctaaggccacggacatccctgccagtgcctcgcctcccccagttgctggggtgcccttcttcaagcagtctccagggcaccagagccctcttgcctcccccaaagtgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcacaaggactgtaactcaggtcccctcagatcctgatccacctgcccccttggctgagggggccttcttggctgaggctagcctcttgaagctgtcccctgcaacacctacttctgagggtccaaaggtggtgagccttgttgggctaggacctggggatgatgggggctgcagctctcctgcttcaaggcccccaatggtggggaagaaacaggtggctgcatgcctgggccattctcctg

SEQ ID NO: 276489 - DNA, 401 bp, Homo sapiens
ccccccatgtctgtcctgagtgtgggggcaacttcctgcaagccaattttcagacccatctccgggaggcctgtctgcacgtctctcgccgtgtaggatacaggtgcctcggacccttcctccatagaactgtagggtttcgtgtgtcctagcctcagcctcagatggcctttcaagatcccctatcttccctgctatatccctcagccctgttgttttgccagactcaaccctgagatagtacgtcctgccttcccgtcgtcccccatggagatggggggaagcagggccacctctggagctccagctctcccttggcagcctcccttggggcacagcctctgcacctctctcctttctccaccctgctcatgctccactactgatttccttcttgtagt

SEQ ID NO: 276490 - DNA, 770 bp, Homo sapiens
atggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaaggtgggcaccggaacgtggccgcagcgcttatctgtgaatttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgattgcccattgattgttcagtttgctgctaacgatgcaagacttttatctgatgctgctcgtatagtctgtccttatgcgaatggaatagacattaactgtggttgccctcagaggtaaagctcaaagaagttggaagaattttccaaaagagtagaaa

SEQ ID NO: 276491 - DNA, 2250 bp, Homo sapiens
atggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgattgcccattgattgttcagtttgctgctaacgatgcaagacttttatctgatgctgctcgtatagtctgtccttatgcgaatggaatagacattaactgtggttgccctcagaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaagaacaggaaattctgaatagaattgcactcagaacttatattaaaaattccatttggttaatgacattaaatttggtacatttcaaaacttctaggtcctccaaagattgaaagcttaataatctcctacctaaaaagataaaattaattgcaatctaccatatcttaagtataggaaatttggtgtccaacctggagatgattatatatttgaaatatttcctagagaatagtaaccaggttttgtttttaactttaaaacctaattacttttgtgcctctcagccgttgattgtaactttaaagtcccatggttttggagtgttattaatagattttgttatcggtgggcatgcactgcaagaattaagtatctcagactgaaataaaaccgtcataattaaagtattattttgttttgccaacatgaaaactgttataaggaaacaattatgtaaaactgtttaattcacgtttgggaatattgaatgaatccattttaacataaaa

SEQ ID NO: 276492 - DNA, 2510 bp, Homo sapiens
atggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaaggtgggcaccggaacgtggccgcagcgcttatctgtgaagcaagtattaaacctcagaacaggggccgcgcggcgtaaggcaggagagcagagcggaggtttcagggagcttcgtttgccctccacactcacaagagtcacgcgttagttgctacacagctttatctgttccacgccttgattggcactcctggggtaataaaagcccgcaggaaatgcttgggaagaaaagttgctggggatgaacagtgaagagaattagggagagtcgatgaagaaggaagtctgaaccataaaaggaccaataaaactcactgtctctaccctccttccttcccatgagacctttgaccttttgccttttctacttcttcctcagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaagaacaggaaattctgaatagaattgcactcagaacttatattaaaaattccatttggttaatgacattaaatttggtacatttcaaaacttctaggtcctccaaagattgaaagcttaataatctcctacctaaaaagataaaattaattgcaatctaccatatcttaagtataggaaatttggtgtccaacctggagatgattatatatttgaaatatttcctagagaatagtaaccaggttttgtttttaactttaaaacctaattacttttgtgcctctcagccgttgattgtaactttaaagtcccatggttttggagtgttattaatagattttgttatcggtgggcatgcactgcaagaattaagtatctcagactgaaataaaaccgtcataattaaagtattattttgttttgccaacatgaaaactgttataaggaaacaattatgtaaaactgtttaattcacgtttgggaatattgaatgaatccattttaacataaaa

SEQ ID NO: 276493 - DNA, 2132 bp, Homo sapiens
atggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaagaacaggaaattctgaatagaattgcactcagaacttatattaaaaattccatttggttaatgacattaaatttggtacatttcaaaacttctaggtcctccaaagattgaaagcttaataatctcctacctaaaaagataaaattaattgcaatctaccatatcttaagtataggaaatttggtgtccaacctggagatgattatatatttgaaatatttcctagagaatagtaaccaggttttgtttttaactttaaaacctaattacttttgtgcctctcagccgttgattgtaactttaaagtcccatggttttggagtgttattaatagattttgttatcggtgggcatgcactgcaagaattaagtatctcagactgaaataaaaccgtcataattaaagtattattttgttttgccaacatgaaaactgttataaggaaacaattatgtaaaactgtttaattcacgtttgggaatattgaatgaatccattttaacataaaa

SEQ ID NO: 276494 - DNA, 1982 bp, Homo sapiens
atggctccaggcccacctggcgaactgactctcagcccgcgcctgggctaagcctggctaggagccgcgcagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaagaacaggaaattctgaatagaattgcactcagaacttatattaaaaattccatttggttaatgacattaaatttggtacatttcaaaacttctaggtcctccaaagattgaaagcttaataatctcctacctaaaaagataaaattaattgcaatctaccatatcttaagtataggaaatttggtgtccaacctggagatgattatatatttgaaatatttcctagagaatagtaaccaggttttgtttttaactttaaaacctaattacttttgtgcctctcagccgttgattgtaactttaaagtcccatggttttggagtgttattaatagattttgttatcggtgggcatgcactgcaagaattaagtatctcagactgaaataaaaccgtcataattaaagtattattttgttttgccaacatgaaaactgttataaggaaacaattatgtaaaactgtttaattcacgtttgggaatattgaatgaatccattttaacataaaa

SEQ ID NO: 276495 - DNA, 2170 bp, Homo sapiens
atggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaaggtgggcaccggaacgtggccgcagcgcttatctgtgaatttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaagaacaggaaattctgaatagaattgcactcagaacttatattaaaaattccatttggttaatgacattaaatttggtacatttcaaaacttctaggtcctccaaagattgaaagcttaataatctcctacctaaaaagataaaattaattgcaatctaccatatcttaagtataggaaatttggtgtccaacctggagatgattatatatttgaaatatttcctagagaatagtaaccaggttttgtttttaactttaaaacctaattacttttgtgcctctcagccgttgattgtaactttaaagtcccatggttttggagtgttattaatagattttgttatcggtgggcatgcactgcaagaattaagtatctcagactgaaataaaaccgtcataattaaagtattattttgttttgccaacatgaaaactgttataaggaaacaattatgtaaaactgtttaattcacgtttgggaatattgaatgaatccattttaacataaaa

SEQ ID NO: 276496 - DNA, 1908 bp, Homo sapiens
atggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaaggtgggcaccggaacgtggccgcagcgcttatctgtgaagcaagtattaaacctcagaacaggggccgcgcggcgtaaggcaggagagcagagcggaggtttcagggagcttcgtttgccctccacactcacaagagtcacgcgttagttgctacacagctttatctgttccacgccttgattggcactcctggggtaataaaagcccgcaggaaatgcttgggaagaaaagttgctggggatgaacagtgaagagaattagggagagtcgatgaagaaggaagtctgaaccataaaaggaccaataaaactcactgtctctaccctccttccttcccatgagacctttgaccttttgccttttctacttcttcctcagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaaga

SEQ ID NO: 276497 - DNA, 2201 bp, Homo sapiens
atggctccaggcccacctggcgaactgactctcagcccgcgcctgggctaagcctggctaggagccgcgcaggtactcgagcagtgggcgcccagggtccgagtgctctgcgcccagcgcaccgagggagccaaggccgtcgggccggcgctttcagctgtctctcgcagcagctcagggccgcgccccctgggctggcgtcgtgccctagccaaggagaaggtgggcaccggaacgtggccgcagcgcttatctgtgaagcaagtattaaacctcagaacaggggccgcgcggcgtaaggcaggagagcagagcggaggtttcagggagcttcgtttgccctccacactcacaagagtcacgcgttagttgctacacagctttatctgttccacgccttgattggcactcctggggtaataaaagcccgcaggaaatgcttgggaagaaaagttgctggggatgaacagtgaagagaattagggagagtcgatgaagaaggaagtctgaaccataaaaggaccaataaaactcactgtctctaccctccttccttcccatgagacctttgaccttttgccttttctacttcttcctcagtttcagtcacgtgccagactttttcttaattacaaactgatagatggtccacatctcaactaacagtattgacgctgtaagagcatcagatttgaaacatatctgtattaatgaagagtgactgcatgcaaacgacaatatgtcaggaaagaaaaaaagatcccatagaaatgtttcattctggacagctggtaaaagtctgtgccccaatggttcgatattcaaagttggcttttaggacactagtaagaaaatatagttgtgatctgtgttacacaccaatgattgttgccgctgattttgtcaaatctataaaagccagagacagcgaatttaccacaaatcaaggtgggcaatggcagaaggttatggggcttgcttaataaacaagccagagcttgttcaagacatggtgaaacaagtaagaaatcaagtggaaacccctggattttcagtttctattaaaataaggatccatgatgaccttaaaagaactgtagatctttgtcaaaaggctgaagcaacaggagtttcatggattacagtccatggaagaactgctgaagaaagacatcagccagtgcactatgattccattaaaataattaaggaaaatatgtctatacctgtaattgctaatggagacatcagaagcttaaaggaagcagaaaatgtgtggcggattactgggacagatggtgtgatggttgcaagaggactcttagcaaacccggccatgtttgctggatatgaggaaaccccactgaaatgcatctgggactgggttgacattgctcttgaactcgggactccttacatgtgtttccatcaacatttaatgtacatgatggaaaagataacttcaaggcaggaaaaaagggtatttaatgctctgtcaagcacatcagcaatcatagattaccttacagaccattatggcatttgactagacttcccaaataattttaatatatacttttagacccacagtgaaaccacagaaggtcatattttgtaccttaaaccagtagctctcaaattttagtataaaaacaattcctgggagcgttttttaaaaatcagttgtagacaccaccctcagagattctgattaggtagatctggagtagacccagaaatacacagtttaaagaaaactcccagtggttcaaacatcctgatcatcctaggcaaacattgacaaatactgctctgaatcctgttctatagatattggggggatgggtagagtgggaattttttcctaatcatgtttttaacattttaaaataaaatttaatactaagaaattatggcttatagtatctataaattaacaagaagtatgcaggtgcaaaaaagtggtggaacaaataccaacatccatccaaaatgaaaaagaacaggaattgatggaattgctcagaattttttaaatccttggctatgcttaattggatttcaatttagtcttaagatgaggtaaatctactaagaaatatgggtcattagtgagatgggccggggatatgatcaaaagggggttacaattgtcgcggggaacagggaaaagggcgaacaacatgtggatagtgaaaaac

SEQ ID NO: 276498 - DNA, 467 bp, Homo sapiens
  misc_feature (10)..(11): n is a, c, g, or t
atccgaggtnncatttcaccctcaggcagcacggagtgaacaagagatggggtctcactttgtcacccaggctgggctcaaactcttggcttcaagcgatcttctcgccttggtctcccaaagtgctgggattacaggcttgaactactgtactcgactgacttttcctatttctaatgtcagcatgaagaacacaagaagtcagcttcaaaggcatccagcaatatcatctattctccactttgctaaatcttacctttggcagagccttcatgaacaagattggtacccatataaaagaagcccgagagagctatcttgaccctcctaccatgtgaagacacaacaaggtaccgtctatgaaccaggaaatgggccctcaccagacacctaatctgctggtgccttgatcttggacttcccagcttctagaactgtgggaattaaatttctattgtttataagct

SEQ ID NO: 276499 - DNA, 575 bp, Homo sapiens
  misc_feature (10)..(11): n is a, c, g, or t
atccgaggtnncatttcaccctcaggcagcacggagtgaacaagagatggggtctcactttgtcacccaggctgggctcaaactcttggcttcaagcgatcttctcgccttggtctcccaaagtgctgggattacaggcttgaactactgtactcgactgacttttcctatttctaatgtcagcatgaagaacacaagaagtcagcttcaaagagtctagaagagcaaacattcactttgcagcctcccttgtaccaaggagtggccatgagacaattctgcccaatgaatcagaagaggaattgtgttgaggatttctggaaagactacttcttttcccaagaaaaagtgacagatgcagtaggggctgagcaacttccgtgcctcttccagccttacggatgtgctgttggtagctgtgactgccttgctactacgaggaaaaggaaggccaagagaatagcagagacactcgctctgatgcctttgagccaatgaatcaatgccagaagcagctgacctccagagttcttgttacaggattaaaataaatctctacttatttgccattgtca

SEQ ID NO: 276500 - DNA, 384 bp, Homo sapiens
cccattttcaaaagaagtgatgctgtcataacctgctcctagggttccaacaggacttcctgtcattctacaagattccagggataggttcataatgattgcttaggtgtgcaggctgacattataaagctaggggatagtgcagtgtagtggggaacagcaagagttctggagttagacgaaactaggcagactcttactttgctgtttactgcttgtgtgatgtggtcaagtcttgtacctacattgagttcatttggacctacatcaacatgtttgtatttttttaaactagaatttcccaaatgaaaatcatttagtattcttgaaatgacttgaaactggtttctctgacagtagactcttatcatcaaaatctctaag

SEQ ID NO: 276501 - DNA, 1741 bp, Homo sapiens
tacaggcagttgtaaagtcgctggccagctagtggagtggagactgcagagggagataaagagagagggcaaagaggcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtcaacactggacgtatgagggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgaggtgggtgagactaagaatatagcttatgaacacattctgagtcacttgcatgaagtcaggcataaagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagcccttcagcctctcaatcagcgcatggtctttgcttctttcatccaagcaggatcctcgtataccacaggtgaaatgctgagtctaggtgtaggaatcttggttggctgtctctgccttctcctggctgtttatttcattgctagaaagattcggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcctagagaggaatggacccaggctgtcattccaggaagaactgcagagccttcagcctctccaaacatgtaggaggaaatgaggaaatcgctgtgttgttaatgcagagaacaaactctgtttagttgcaggggaagtttgggatataccccaaagtcctctaccccctcacttttatggccctttccctagatatactgcgggatctctccttaggataaagagttgctgttgaagttgtatatttttgatcaatatatttggaaattaaagtttctgacttta

SEQ ID NO: 276502 - DNA, 2071 bp, Homo sapiens
tacaggcagttgtaaagtcgctggccagctagtggagtggagactgcagagggagataaagagagagggcaaagaggcagcaagagatttgtcctggggatccagaaacccatgataccctactgaacaccgaatcccctggaagcccacagagacagagacagcaagagaagcagagataaatacactcacgccaggagctcgctcgctctctctctctctctctcactcctccctccctctctctctgcctgtcctagtcctctagtcctcaaattcccagtcccctgcaccccttcctgggacactatgttgttctccgccctcctgctggaggtgatttggatcctggctgcagatgggggtcaacactggacgtatgagggcccacatggtcaggaccattggccagcctcttaccctgagtgtggaaacaatgcccagtcgcccatcgatattcagacagacagtgtgacatttgaccctgatttgcctgctctgcagccccacggatatgaccagcctggcaccgagcctttggacctgcacaacaatggccacacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagagctccacattgtacattatgactctgattcctatgacagcttgagtgaggctgctgagaggcctcagggcctggctgtcctgggcatcctaattgaggtgggtgagactaagaatatagcttatgaacacattctgagtcacttgcatgaagtcaggcataaagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacagctggaaaagcttcaggggacattgttctccacagaagaggagccctctaagcttctggtacagaactaccgagcccttcagcctctcaatcagcgcatggtctttgcttctttcatccaagcaggatcctcgtataccacaggtgaaatgctgagtctaggtgtaggaatcttggttggctgtctctgccttctcctggctgtttatttcattgctagaaagattcggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcctagagaggaatggacccaggctgtcattccaggaagaactgcagagccttcagcctctccaaacatgtaggaggaaatgaggaaatcgctgtgttgttaatgcagagaacaaactctgtttagttgcaggggaagtttgggatataccccaaagtcctctaccccctcacttttatggccctttccctagatatactgcgggatctctccttaggataaagagttgctgttgaagttgtatatttttgatcaatatatttggaaattaaagtttctgactttaattctggcctatcctttgaggctcttgagggtgggcaagttcctgaatccctcaggtggtaaagatgggcaaaggatggggaaaagaagcatgggtgattaactccttttatcccacccctggaaggaaagataagcttctgggaaaacacttaacccaaagtttcagacatgttaaaccactagcccagatttctgcccttgcaccaaggctatgcttggaaatcagtggttgccaggttaggaaagtggctggatgagagatctgaggacagaaatctcaattaacatgctatcccctcccttaaaagccaagttcccccacaattac

SEQ ID NO: 276503 - DNA, 843 bp, Homo sapiens
cacaggtaaaagcacaggctccaaggagttgtaggctccagctcagatcttaggagtcagatccttttgtagttcatgggcatgatgatggggtgttcctgagcatgcgtaagatgtgccgccctcaaatcttgtcaagatgttggcacattacccatctgacataaataaacaaacaaataacctcaggagtcagaggaaagcagcattttcctaacctacgaattctcaaaaacctttgtccatgaatttggagatatgagaatggggatcaggatcctgtagccaaagcgggaatcgaaatgtttataaccaagctcagtaggtaggtatcattgcactgacttggtcttcaccaagaaaaaggaagatatgctagaaaagcactggcctatgggaggaactgggtgctactgggggagaaaactggaagagggccaagtctcccaagaagtggtggcaacccaggagtgggaatgtatccacatgcctccaccaatccgagtttgctcttttcctcacagtgcaactctctctgccctctaccctgtatctgggtggacttccccgaaaatatgtagctgcccagctccacctgcactggggtcagaaaggatccccaggggggtcagaacaccagatcaacagtgaagccacatttgcagaggtaccagggaacaaagagctgggactcagacaaagtaacagggatgggtggtcctggggaaaggatctggaccttaggaaaagtcatgctggggggataaggccaatctctgagggacagacttagtgcctgccggggacagcggggggatggtggcagctaggatcaaggccttg

SEQ ID NO: 276504 - DNA, 585 bp, Homo sapiens
ccaggctggtctccaactcctgacctcaagtgatccgcccgcctcagcctcccaaagtgctgggattataggtgtgaaacaccttgcccagccctcttttctgttaaaaagcattctcctatttcacctctaatctgcttcacttagatagcagtcattctcatgagccattcccctttccaggaagaagaggctggaaaaccgaaagagtgtggtcttcacctcagcacaagccacgactgaggcataaattccttctcagataccatggatgtggatgacttcccttcatgcctatcaggaagcctctaaaatggggtgtaggatctggccagaaacactgtaggagtagtaagcagatgtcctccttcccctggacatctcctagagaggaatggacccaggctgtcattccaggaagaactgcagagccttcagcctctccaaacatgtaggaggaaatgaggaaatcgctgtgttgttaatgcagagaacaaactctgtttagttgcaggggaagtttgggatataccccaaagtcctctaccccctcacttttatggccctttccctagatatactgcg

SEQ ID NO: 276505 - DNA, 729 bp, Homo sapiens
ctccacattgtacattatgactctgattcctatgacagcttgagtgaggctgctgagaggcctcagggcctggctgtcctgggcatcctaattgaggtcagtagcccccagtcccttccaggtttctctccacttcctctgcaaccctcaaacctatttctgttgctggcctccttcctatggcaggcagcagcccaccctgaccatttattctgtacataaatttcttattccaaacatggactcattccaaactctctccctttccttctcttccaggtgggtgagactaagaatatagcttatgaacacattctgagtcacttgcatgaagtcaggcataaaggtgagccttaaaaatctatagcaggaagtaagattagactttcaaaaactatccttaaaagccttgggatgaagcaattacatagagccaaggaattttgcttctgggagccctatctaggtaagctagggcacactgaaaggaagatgagtcccagtctgttctccccagatcagaagacctcagtgcctcccttcaacctaagagagctgctccccaaacagctggggcagtacttccgctacaatggctcgctcacaactcccccttgctaccagagtgtgctctggacagttttttatagaaggtcccagatttcaatggaacaggtaagtggtggagaaacgaggtgaggtgagacacagttgtaacttcagacccct

SEQ ID NO: 276506 - DNA, 324 bp, Homo sapiens
ctccagatacttactgaggcagaggagagtgggtggtgggaaaaaagagtgggttgggggtaaggagggaatcttttttttgacgcttttgctttaaaattcagagttggattggtcaggatttatgggctctttgccatgtaaatttttctcattctccaggttctagcttgccaggttctagcctgccgggttctagctctccatgttctagctctacaggttctagcccttccaggttctagccctccaggttctggctctccaggttctagcccttctaggttctaacctgccaggttctagccctccaggttctagccc

SEQ ID NO: 276507 - DNA, 1580 bp, Homo sapiens
tcgatgtttgaatggaggagccacagctcctccgtattgtcctgccgggaggacaggatcaagtggtggcccgtcaggcacagggtgccctcgacagccgggtagaaaggccggtgcagcaccacattgtccacccgcggggtcttaatcagctccgcaaactccatgctccccccgcggccggagccagggaaccgagcccggtaggtgcgaggcggttaccccgccgcagggaagtagcggaaacacccggcgcggggctggcccgtggggcggggcgggccgggcggtgaggctgggcccgccccaggctgggtgggcgcggcgaggcctacagccgccggcaccggccgcggggagacaggggctggggctggacgaggcccaagcgcctctcccgcaccgcgcggttcaccaggcctaggactcggccacagagaacccctctccacaggcccaaggaccgccgctgccgttgggctccgggtcccgcgttggcaagcggagggcagtaggagaaagccgcctcagaatccgcttccacgccctggccgctagggactcctagcggaagtggctactcgctgctggagcccacaacaactccgggcggaagcagcaggtctcgaaactcggaagacgcggaagtcgcagccggaagttggtcctcgctaggtcctctggaaatgcctccggaaacacagccagaccagaagatgtgtgttcctacgagaaaaaaagcttgtctttgccttcacgccctcccgctgcctttcttaaccacctacaaatattccttatcagaagaggtccgggaagagggaggaggtccctgtcttgccttcctccgcttgagtagtatcccctccagaagctcttcagagcgtggggctgctgtaaattgtgataattgttatgcattagccctgaagacatggcaagtaggggatggaggcggtgactgtgaccttacggaatcctccaggggtcagggagggacacagggccactccacaggctctccgagagcgccgcgccacgaggtgtaacctggagcaagaaagaggaaaaacaggaatacctgtgagaggaacccaagtacatgcagtgcacagaagagcaagtcacttgacttgctggcggccaccccgttaatctgcagcagagcctggacttcagtctgcatctgtgaaacccagcgcatgggtgcgttggtcaccaccgcacagcctccccgtcagacacccacgtttcgccaaaaatttattcaaataattactcctttgcttgttcctttcccaccgcccacttctgacatttttattcaaaagtaggaaatagaagagaaatatgtttgagtgctggtctgctgtgacttcattgaccttttaaatcctcaccatctagtacctaagcacagcgagttggacaaactctcacagtattcacaaagtaaattgccacaacctcatcagctcatccaacacttgtccatgcttttgattttgtccttcttaaaatgtacccttcttaaaataaaccactttatagacttgttttaagtgagatacgtaaatgcc

SEQ ID NO: 276508 - DNA, 1329 bp, Homo sapiens
tcgatgtttgaatggaggagccacagctcctccgtattgtcctgccgggaggacaggatcaagtggtggcccgtcaggcacagggtgccctcgacagccgggtagaaaggccggtgcagcaccacattgtccacccgcggggtcttaatcagctccgcaaactccatgctccccccgcggccggagccagggaaccgagcccggcccaaggaccgccgctgccgttgggctccgggtcccgcgttggcaagcggagggcagtaggagaaagccgcctcagaatccgcttccacgccctggccgctagggactcctagcggaagtggctactcgctgctggagcccacaacaactccgggcggaagcagcaggtctcgaaactcggaagacgcggaagtcgcagccggaagttggtcctcgctaggtcctctggaaatgcctccggaaacacagccagaccagaagatgtgtgttcctacgagaaaaaaagcttgtctttgccttcacgccctcccgctgcctttcttaaccacctacaaatattccttatcagaagaggtccgggaagagggaggaggtccctgtcttgccttcctccgcttgagtagtatcccctccagaagctcttcagagcgtggggctgctgtaaattgtgataattgttatgcattagccctgaagacatggcaagtaggggatggaggcggtgactgtgaccttacggaatcctccaggggtcagggagggacacagggccactccacaggctctccgagagcgccgcgccacgaggtgtaacctggagcaagaaagaggaaaaacaggaatacctgtgagaggaacccaagtacatgcagtgcacagaagagcaagtcacttgacttgctggcggccaccccgttaatctgcagcagagcctggacttcagtctgcatctgtgaaacccagcgcatgggtgcgttggtcaccaccgcacagcctccccgtcagacacccacgtttcgccaaaaatttattcaaataattactcctttgcttgttcctttcccaccgcccacttctgacatttttattcaaaagtaggaaatagaagagaaatatgtttgagtgctggtctgctgtgacttcattgaccttttaaatcctcaccatctagtacctaagcacagcgagttggacaaactctcacagtattcacaaagtaaattgccacaacctcatcagctcatccaacacttgtccatgcttttgattttgtccttcttaaaatgtacccttcttaaaataaaccactttatagacttgttttaagtgagatacgtaaatgcc

SEQ ID NO: 276509 - DNA, 1475 bp, Homo sapiens
tcgatgtttgaatggaggagccacagctcctccgtattgtcctgccgggaggacaggatcaagtggtggcccgtcaggcacagggtgccctcgacagccgggtagaaaggccggtgcagcaccacattgtccacccgcggggtcttaatcagctccgcaaactccatgctccccccgcggccggagccagggaaccgagcccggtaggtgcgaggcggttaccccgccgcagggaagtagcggaaacacccggcgcggggctggcccgtggggcggggcgggccgggcggtgaggctgggcccgccccaggctgggtgggcgcggcgaggcctacagccgccggcaccggccgcggggagacaggggctggggctggacgaggcccaagcgcctctcccgcaccgcgcggttcaccaggcctaggactcggccacagagaacccctctccacaggcccaaggaccgccgctgccgttgggctccgggtcccgcgttggcaagcggagggcagtaggagaaagccgcctcagaatccgcttccacgccctggccgctagggactcctagcggaagtggctactcgctgctggagcccacaacaactccgggcggaagcagcaggtctcgaaactcggaagacgcggaagtcgcagccggaagttggtcctcgctaggtcctctggaaatgcctccggaaacacagccagaccagaagatgtgtgttcctacgagaaaaaaagcttgtctttgccttcacgccctcccgctgcctttcttaaccacctacaaatattccttatcagaagaggtccgggaagagggaggaggtccctgtcttgccttcctccgcttgagtagtatcccctccagaagctcttcagagcgtggggctgctgtaaattgtgataattgttatgcattagccctgaagacatggcaagtaggggatggaggcggtgactgtgaccttacggaatcctccaggggtcagggagggacacagggccactccacaggctctccgagagcgccgcgccacgaggtgtaacctggagcaagaaagaggaaaaacaggaatacctgtgaaacccagcgcatgggtgcgttggtcaccaccgcacagcctccccgtcagacacccacgtttcgccaaaaatttattcaaataattactcctttgcttgttcctttcccaccgcccacttctgacatttttattcaaaagtaggaaatagaagagaaatatgtttgagtgctggtctgctgtgacttcattgaccttttaaatcctcaccatctagtacctaagcacagcgagttggacaaactctcacagtattcacaaagtaaattgccacaacctcatcagctcatccaacacttgtccatgcttttgattttgtccttcttaaaatgtacccttcttaaaataaaccactttatagacttgttttaagtgagatacgtaaatgcc

SEQ ID NO: 276510 - DNA, 1159 bp, Homo sapiens
gcttcaactgtgctatattgtttattattatagaaaacctatgtcaaggcaggtattatccttacattagagataaagcaggcctcacagattttgtccaaggtcgtgaagtccaggtttgaactcacatccctctgagtcacatgttcttaacattatacccacgtgggaggtaacaaatgctaaagacatgcatatatagaaaaagataagttatttatgatttttcccctgaaattgttatttctttcttagaggctggaaaaaattcaaaaggtccagttaaattgcactaaggtgaagagtaagcaaagtgagcccagcaagcactcagggttttctacctcagacaacagcatagccaacactccccaggattacagtgggaatatgaaatcatttccatcccggagcccttcacaaggcgatgaagattctgctctgattctaacccaagacaatctgaaaagttcagatccagatctgtcagccaacagtgaccaagagtccggggtggaggatttgagctgtcggtctccaagtggtggtgagcatgcaccgagtgaagatagtggcaaggaccgggattctgatgaagccgtgtttctcactgcctgaagtttccctttggagttccaaagtaaaggacacataagcaacacttccaaaaacaagggaacaaggtggtttattgtaaaaacaggaaatggtgcatgtcattgagaactactttaatgcagctatgaaaagggaaaaaagtgcccagttcttgatttcttagatactgaagaggacgtagtcatttcatttatcaaatataaggaaaattattcaccattttgaagctcaccctagactatgaaaattatattcactgcagagcaattacttctgtcattacctgaagtgatcagtatctatcttccttgtcatagcatgcatctctcaaaaagcctccactcctttccctcacatctgtgatcatcatgattcttttagttcacttctagatgcatattttgtgttttctaaagcatctgacattatcctcctttccgaccctcttatacatatttctaaaaacaggcacattggtgagatgcaccctttttagttaatagatgcattcctaaggagcttttaattgcttatctttcag

SEQ ID NO: 276511 - DNA, 2137 bp, Homo sapiens
gggctgcaggattcggacgagggagcacatccgcacgccaaggttgaaaatgtccgcttggtagatcgagtgtctcctaaaaaagcagctctaggtactttgtatttgacggctacccatgtcatattcgtggaaaattcacctgacgcaagaaaagaaacatggattcttcacagtcagatttccaccattgagaaacaggcaacaaccgctaccggatgccctctgctgattcgctgcaagaactttcagataatacagctcatcatacctcaggaaagagattgccacgacgtgtacatctccctgatacgccttgcaaggccagtgaaatatgaggagttatactgcttttcattcaaccccatgctggataaagaagaaagagagcaaggctgggtgctgatcgatcttagtgaagaatacacgcggatgggcctccctaatcattactggcagctcagcgatgtgaatagagactatagagtctgtgactcttatcctactgaactgtacgttcccaaatcggccacggcacacatcatagtggggagttccaaattccggagtagacggcgatttcctgtcctttcttactattataaagataaccacgcctccatctgccggagcagccagcccctgtccggcttcagtgcccggtgcctagaggacgagcagatgctccaggccattaggaaagccaatccaggaagtgacttcgtttatgtcgttgacacccggcctaaacttaatgcaatggcaaatcgtgctgcagggaaaggctatgagaatgaagacaattattccaatatcaagtttcagtttatcgggatagagaacatccatgtcatgaggaacagtctgcagaaaatgctggaagtgtgtgaacttaaatctccctccatgagtgatttcctgtggggtctggagaactctggctggttaaggcacattaaagccataatggatgcaggaatcttcattgcaaaggcagtgtcagaggaaggggcaagtgtgcttgttcactgttctgatggctgggacaggaccgctcaggtgtgctcggtggcaagcctgctgctggaccctcactaccggactctgaagggcttcatggtattaattgaaaaggactggatttcctttggtcataagtttaatcaccgatatggcaatctagatggtgacccaaaagaaatctctccagttattgaccagttcattgagtgtgtttggcagttaatggaacaatttccctgtgcctttgagttcaatgagaggtttttgattcacattcaacatcacatttattcctgccagtttggaaacttcctatgtaacagccaaaaggagagacgagaactcaagattcaagaaagaacatactcattatgggctcacctgtggaagaatcgggccgactacctgaatcctctgtttagagctgatcacagccagactcagggaacccttcatctccctacaacaccatgtaacttcatgtacaagttttggagtggaatgtataaccgctttgaaaaggggatgcagccccgacagtcagttacagattacctaatggcagtgaaggaagaaactcagcagctagaggaagaactagaggccctggaagaagtaagacatacttgctttgttaatctattttctgtgcttatttcttgaagagcaaggcttcatgaaagcctcttaagattcagtgcaatacaaatatttcacatttttagtcagtagaacacctgaaacacaaccccatccaggtcaggactcagataaccgaagcccaaacctaggcatttaatgcatttcacacatctggtttgtggctcagttccacaaatttttggttgttccttattttaggtcaacttgtttggttactgttatttgagagtagtaaaattaatttttttctggaaagtgtgaaaaagtaacagaataaaatcaaatatatgtacttgtaaaactctttccccacttttagaaattatgttaactatgatattaatctataattggtaaaggggagactgactgtaaagtcttatcttttggcttctatgaacttccctgtacttggacagggaggttataataaaatgcttttcctaattgg

SEQ ID NO: 276512 - DNA, 2542 bp, Homo sapiens
gggctgcaggattcggacgagggagcacatccgcacgccaaggttgaaaatgtccgcttggtagatcgagtgtctcctaaaaaagcagctctaggtactttgtatttgacggctacccatgtcatattcgtggaaaattcacctgacgcaagaaaagaaacatggattcttcacagtcagatttccaccattgagaaacaggcaacaaccgctaccggatgccctctgctgattcgctgcaagaactttcagataatacagctcatcatacctcaggaaagagattgccacgacgtgtacatctccctgatacgccttgcaaggccagtgaaatatgaggagttatactgcttttcattcaaccccatgctggataaagaagaaagagagcaaggctgggtgctgatcgatcttagtgaagaatacacgcggatgggcctccctaatcattactggcagctcagcgatgtgaatagagactatagagtctgtgactcttatcctactgaactgtacgttcccaaatcggccacggcacacatcatagtggggagttccaaattccggagtagacggcgatttcctgtcctttcttactattataaagataaccacgcctccatctgccggagcagccagcccctgtccggcttcagtgcccggtgcctagaggacgagcagatgctccaggccattaggaaagccaatccaggaagtgacttcgtttatgtcgttgacacccggcctaaacttaatgcaatggcaaatcgtgctgcagggaaaggctatgagaatgaagacaattattccaatatcaagtttcagtttatcgggatagagaacatccatgtcatgaggaacagtctgcagaaaatgctggaagtgtgtgaacttaaatctccctccatgagtgatttcctgtggggtctggagaactctggctggttaaggcacattaaagccataatggatgcaggaatcttcattgcaaaggcagtgtcagaggaaggggcaagtgtgcttgttcactgttctgatggctgggacaggaccgctcaggtgtgctcggtggcaagcctgctgctggaccctcactaccggactctgaagggcttcatggtattaattgaaaaggactggatttcctttggtcataagtttaatcaccgatatggcaatctagatggtgacccaaaagaaatctctccagttattgaccagttcattgagtgtgtttggcagttaatggaacaatttccctgtgcctttgagttcaatgagaggtttttgattcacattcaacatcacatttattcctgccagtttggaaacttcctatgtaacagccaaaaggagagacgagaactcaagattcaagaaagaacatactcattatgggctcacctgtggaagaatcgggccgactacctgaatcctctgtttagagctgatcacagccagactcagggaacccttcatctccctacaacaccatgtaacttcatgtacaagttttggagtggaatgtataaccgctttgaaaaggggatgcagccccgacagtcagttacagattacctaatggcagtgaaggaagaaactcagcagctagaggaagaactagaggccctggaagaaaggctggaaaaaattcaaaaggtccagttaaattgcactaaggtgaagagtaagcaaagtgagcccagcaagcactcagggttttctacctcagacaacagcatagccaacactccccaggattacagtgggaatatgaaatcatttccatcccggagcccttcacaaggcgatgaagattctgctctgattctaacccaagacaatctgaaaagttcagatccagatctgtcagccaacagtgaccaagagtccggggtggaggatttgagctgtcggtctccaagtggtggtgagcatgcaccgagtgaagatagtggcaaggaccgggattctgatgaagccgtgtttctcactgcctgaagtttccctttggagttccaaagtaaaggacacataagcaacacttccaaaaacaagggaacaaggtggtttattgtaaaaacaggaaatggtgcatgtcattgagaactactttaatgcagctatgaaaagggaaaaaagtgcccagttcttgatttcttagatactgaagaggacgtagtcatttcatttatcaaatataaggaaaattattcaccattttgaagctcaccctagactatgaaaattatattcactgcagagcaattacttctgtcattacctgaagtgatcagtatctatcttccttgtcatagcatgcatctctcaaaaagcctccactcctttccctcacatctgtgatcatcatgattcttttagttcacttctagatgcatattttgtgttttctaaagcatctgacattatcctcctttccgaccctcttatacatatttctaaaaacaggcacattggtgagatgcaccctttttagttaatagatgcattcctaaggagcttttaattgcttatctttcag

SEQ ID NO: 276513 - DNA, 793 bp, Homo sapiens
tttgacttttctgctcttattttactgtttactattattcttttgaattatatgtgagttacatgagtaattacattttcaattttcaatgcttatggtctcttaaagtcttgccctggccctgatcctatctccattctcagccagggcacttcctgcatgtttctgccctagacagaaaggctctgtgaggacagcaactgtgcctctgctcccagagggaaggctccctgggggtggacctggtgtcctctggttttctctccttaatcttgtaccagaggcaagactcaaccaaatggtgctgcatcctgaccataccctcccttctccggctgcaacactgcctatctctccccagacaaaggtgactgtcgcatcttcaccaggtgcatccaagtggaaggacaaggctttgagtatgtcatctttttccagccaacccagaagaagtcggtctgtcttttccaaccaggctcctacctggaggggcccccagggtaaggtcactggtaggaccttggctgcctcctgggcttggctcagcagggcaggttcagcacccaccaggctggccctggagtctctatctttctctaaggggtgaggaagggagtgtggggcactaggcttcagcctcacaataccaggcctggaaggacacacagggttatctggcctaatccccagtgtgcagatatgggcttctcatcaaagtctcaaaattttctggacaaaagacctgagaggccactttgagaagaatgtggtacacttggaagagggcaagatc

SEQ ID NO: 276514 - DNA, 482 bp, Homo sapiens
tttgacttttctgctcttattttactgtttactattattcttttgaattatatgtgagttacatgagtaattacattttcaattttcaatgcttatggtctcttaaagtcttgccctggccctgatcctatctccattctcagccagggcacttcctgcatgtttctgccctagacagaaaggctctgtgaggacagcaactgtgcctctgctcccagaggggctgttcacactaagtctcaacatcaggttcaaaaagtaagtatgggcccctggggcattggccaaagtcacagaccttttcatccctggaagtggccatcctcggcagctggggtgtaggagccctgcctgccactctccttccccagcccactcccaagcaattcctctagtccctggccaggacacagcctctgctgtccaactttgggagctgacaaaaaggccctgagcccagggccacttctgagtcctcgagg

SEQ ID NO: 276515 - DNA, 950 bp, Homo sapiens
tttgacttttctgctcttattttactgtttactattattcttttgaattatatgtgagttacatgagtaattacattttcaattttcaatgcttatggtctcttaaagtcttgccctggccctgatcctatctccattctcagccagggcacttcctgcatgtttctgccctagacagaaaggctctgtgaggacagcaactgtgcctctgctcccagagggaaggctccctgggggtggacctggtgtcctctggttttctctccttaatcttgtaccagaggcaagactcaaccaaatggtgctgcatcctgaccataccctcccttctccggctgcaacactgcctatctctccccagacaaaggtgactgtcgcatcttcaccaggtgcatccaagtggaaggacaaggctttgagtatgtcatctttttccagccaacccagaagaagtcggtctgtcttttccaaccaggctcctacctggaggggcccccagggtttgctcacggcgggtccctggcagccatgatggacgagaccttttctaaaactgccttcctggctggagaggggctgttcacactaagtctcaacatcaggttcaaaaacttgatccccgtggactctctggttgtaatggacgtagaactggacaagattgaggaccagaagctttacatgtcctgcatcgcccacagcagttggaagaagagtctccccagtaacagtcactgtgcctgcaggagagccactgcctcccctgcctgcctcctgcctcctgcctcccctgcctgcctcctgcctcctgcctcccctgcctgcctcctgcctcctgcctcccctgcctgcctgggacccatcaaagagcagggaggggtcctcaagcagcaattggtgaggcgagggaaaggacccttttctctgagtaaataaagtctcacagtccc

SEQ ID NO: 276516 - DNA, 1001 bp, Homo sapiens
gaagcggccccaagtgcagctgaaagcactccttgggagtcagccaagaccctccatccaagcagggctggatccttgcacttggccatgataaggagatgcttccaggtggcagcaagacttggccaccacagaggccttcttgaggccccccgtatcctgcccagactcaaccctgcctcagcatttggatcctccacagactccatgttctcaagattcttgccagagaagacagacttgaaggattatgctcttcccaatgccagctggtgttcggacatgctgagcctgtaccaagaatttctggagaagactaagtctagcggctggatcaagctgccctccttcaagtccaacagagaccacatccggggactcaagctcccatctggactggcagtttcctcagacaaaggtgactgtcgcatcttcaccaggtgcatccaagtggaaggacaaggctttgagtatgtcatctttttccagccaacccagaagaagtcggtctgtcttttccaaccaggctcctacctggaggggcccccagggtttgctcacggcgggtccctggcagccatgatggacgagaccttttctaaaactgccttcctggctggagaggggctgttcacactaagtctcaacatcaggttcaaaaacttgatccccgtggactctctggttgtaatggacgtagaactggacaagattgaggaccagaagctttacatgtcctgcatcgcccacagcagttggaagaagagtctccccagtaacagtcactgtgcctgcaggagagccactgcctcccctgcctgcctcctgcctcctgcctcccctgcctgcctcctgcctcctgcctcccctgcctgcctcctgcctcctgcctcccctgcctgcctgggacccatcaaagagcagggaggggtcctcaagcagcaattggtgaggcgagggaaaggacccttttctctgagtaaataaagtctcacagtccc

SEQ ID NO: 276517 - DNA, 1626 bp, Homo sapiens
aaatccgtcccattctggatccttattccagctcctttccctctgcgaatcgcacttggtgggtcgcggggccctcagtaattagggatcacggatcagccaagaaaaatacaggttttcttaagcctgaagccactgacttgaggagggagcgtgggagtaatgtcagtagcagttttttatttcgttttcgtttttattttctagtcactaggccaccaaagaaagttccacccaacggccagtcgatccgtcgcagcgactctcttttccctgaacggagggtttatggctgacacctccacttgtttctcagagccggggctgactgccggctgcatctttgaatggcgaccaaaaaagacatgcatttgtctggcaaagtcgctggcgttcgcctggtgcccgcgcttgccgggtcctagagcagccagattttcacaccagcgagtccagcgcccagcgccactcctccttcggatcaccggtttctcacatccgcagcagcactggcctgacagttttccggttgcgacagcgctagttgagccaaacaaaacgttttcctgcttgctctgggcgtcccattctccatccgaggccttctagtcccggtgtcactgtcgcagcacctggcgttcgttagctctttcaccagcggcgcggagcgggcggttttgctgtcacggcacatgtggcacggagtttctcggtggccgaaaccctcttttttctcagagtccagtttcttggtgacagcgctgttggttgcgccataaggaatgttgtccttgacaacccgccggccgcagtcattcgcaagctccaggcaccgacatttcgcagaactgaggtctctcggtctcagcacagctcgttgctcgatgcctccattttctcggggcgacagcaatcaggtcgccgatctgagggattcggagcttccccagctggggtgagcctggcgttcccgggcggcggcggcggcgctgggctaggggagcccgccgctcctccaagccggtgacaggggagctgcccgggcgccgtctcttcccagcgccgccgcagaacccgcagaacagctcgacctccagaaccctgtgctgtggcggcggggctggtgtgtctgtcgcaggaccccgcagattcgtctgtcgttggcttgttggtcctaacaagtttcgatttcagggtgcctgcgtttctttttcttttctcttcttttccttttgttttgttttgagacagagtctcgccgtgtcgcccagcctggagtgcagtggcgcgatcttggctcactgcaacctccgcaccccaggttcaagggattctactgcctcagcctcctgagtagctgggattacaggcgctcgccaccacgcccggataatttttgtatttttactagaggcggtgtttcatcatattgaccaggctggtctcgaactcctaacctcaataatctgcccgcctcggcctcccaaactgccaggattacagcatgagccgctgcgcccagccggtgactacgatttctatcccctggttcaagtcggggaatagccaaaatgtgatttctcaacccaagcaagtacccacttaggacaaacaccagcctagccc

SEQ ID NO: 276518 - DNA, 342 bp, Homo sapiens
aaatccgtcccattctggatccttattccagctcctttccctctgcgaatcgcacttggtgggtcgcggggccctcagtaattagggatcacggatcagccaagaaaaatacaggttttcttaagcctgaagccactgacttgaggagggagcgtgggagtaatgtcagtagcagttttttatttcgttttcgtttttattttctagtcactaggccaccaaagaaagttccacccaacggccagtcgatccgtcgcagcgactctcttttccctgaacggagggtttagcgatgaccagtttagcagtgcctgggagctcttacaccaaggctagctgcgc

SEQ ID NO: 276519 - DNA, 386 bp, Homo sapiens
ttaaaatagaagcctgatcatatgcctctcctatgtattggtcctttatcaccttggcatggcatagaaggcctctacttgctttgcctcagtttccagtctccactatgctgcatcccatgctccagacatttggaattacttgctgtcatattagcctctgtggattgacaaagactgttgccttcacctgaaattatgtgaccacacttgttttactcagcatcccaaatgcagcccttgtattgaccccttttgttgacaccaccttcagcaagcacagctgatcattcctagttttttttttcctccataagtaacctttcaatagatgtgcctctactggggaatttctattgggtttatttattccacagtgccttccc

SEQ ID NO: 276520 - DNA, 150 bp, Homo sapiens
tcctgcctcagcctcccaaagtggtgggataacacgcatgagccgctgccccaaaagttttatatagtcctttatctttgtcagataagtgatttacgaaggttttcttccactctggcttgccttttcatcctcataacttctatactt

SEQ ID NO: 276521 - DNA, 671 bp, Homo sapiens
aagcctgcagaataaatgaaaacaacaataacaaaaactgggggtcagtcccacaccactattcactgcatctctggaattcagcttttgggattttttttctataaaatgaagttgatattttcccacttcctaaacagaatgaatgttttaaggaacaaggaaagagcatttgctttgaatttctaatattaaaaggaactataagaatagaaatacagttaaccactattttcttaactctcaacgaacagatatatttctgctttaaatgagtgttgtctatcacggccaatcagctgctagcaaactcttaccatttatccaaactctgccctgaggcacttgctgtcttatccaaccaaccatgtacaactctacctccaccctttagctatatacaaggatttcctgtgtcaaagaataatgagtgggcctggcacggtggctcacacctgtaatcccagcactatgggaggccgaggctggtgcatgacctgaggtcaggagttccagaccagcctgaccaagatggtgaaaccctgtctctgctaaaaacacaaaattagctgggtatggtggtgcatgcctgtaatcccaagctacttgggaggctaaggcaggagaatcgcttgaacccaggcagcagagattgcagtgagccgagatca

SEQ ID NO: 276522 - DNA, 517 bp, Homo sapiens
tacactgtagatagttttggaatttcatataaatgattataccgtatgcattatttaagtttggcttcttttgctgtcattatatgagatccatattgtgagtagcagcagttctttttcattgctgaccagaattccttgtgtggatgtctcaatttttgtgtccattctcttattgataatacttttgtattgttggcggtttggggctatgatgaataaacctgctgtgaacattcttgtatttgtcttttggtggatataagcaccctagaggggatttgctgggtcatagtttataaatacatgtagttttagaaaatactgtcaaacagttttccaaattatttgtgtggtatttttcttaataaaactaaggctaattaaaagagcgctgggacttttatttagtttgccatctgcttcaggattgtcccaatataagagaggtaaaattttgagtcttgaatttatcactgttggaactactttctgaaaatagaatttattctcaagt

SEQ ID NO: 276523 - DNA, 714 bp, Homo sapiens
cctcaccctgctcgtctatacttactgccagcggtaccagcagcaatcccacgatgcgactgtcatccaccccgtctcacctgccccccttaataccagcataaccaaccacatcaacaaactggacaagtacgactcggtggaggccatcaaggcatttaacaaaaacaacttgatcctagaggaaagaaacaaatacttcaacccacatctcactgggaagacctattctaatgcctactttacagatctcaataattatgatgagtactaacagctttcatgtttttggcttcttgtaaatccccagttcctcaaggcctgtgccccatgactgcccatgtttctgaggcttcagagtcgaagtttggatacatttcaagtgcatttcaagccaccagagtgtcccattgctgccaaaaatacacgtctttaaaagcaacaaaaattgaaataagacatcgtgaaaatcttgaccattgttgaatgagccagggtgtgaagtttttaattgtgttcatcctatttttctgacaagtccattggtttgttttttgagcattattttataaatgtgccacccacattggaaggagtctttctttagaactttggagtgtaaatcttcatgatgttgtaattcaagaaaataggcactttctctgaaagacctgctccttccacaagaagtgcataggtccataatatttcata

SEQ ID NO: 276524 - DNA, 222 bp, Homo sapiens
acaaaaggaaaagaacactgagagaaaagtctttgatttctttttgaaaagttcatggttatatatcacagtatgtggataattttttggatcctatttaaaaaaaaaaaaaactggctgggcgtggtggctcacgcctataatcgcagcactttgggtgctgcggtaggcggatcatgaagtcaagagatcaagaccagcctgaccaacacggtgaaaccc

SEQ ID NO: 276525 - DNA, 276 bp, Homo sapiens
accaaccagtttctgcctctcgtagagctgacattctgattggggataagtttcacatttttgtgtcatatccttcaaaatagtcaactccttaggtttaatgtctttttatcaacatggagattttgaatgaaattcagccatgagtgtgtgtttgttttcccatgctatctcaatcgtattacagagcagtgttgtggaaacatttaaaaaacaatctctgacatgagtaggaatgtggtcttctaccaggaactttaccgattgcagagaatt

SEQ ID NO: 276526 - DNA, 451 bp, Homo sapiens
aatcccacctcaaagccatagctacattttgatgtatttccttcctgtcattatatacaaacctttaattttttttcattatgaaatatttcagacatacaaatggtataaagataatagaaaaccccatgtagctaccaatgcaactgaagaaatacgccctaaacagtgatgccaaagacccttgcaaaaacctttgctttgcggagtttgatgtttatttctgctttgcatgtccataaatttgctatggacatgtatccctaaagagcatatatatttttaaccagcttttaacatttatataagcatacacagtttttaaaaattgagatcgggcaggcatagtgggcctataatcccagcactttgggaggccgaggcgagaggatcacttgagcccagaagttcgagaccagtctgggcaacacagggagatcctgtttctaca

SEQ ID NO: 276527 - DNA, 2908 bp, Homo sapiens
atgagtgtcagaagtgtgaagggtgcctgttctgaatcccagagcctcctctccctctgtgaggctggcaggtgaggaagggtttaacctcactggaaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctgaaaaagcaca

SEQ ID NO: 276528 - DNA, 2899 bp, Homo sapiens
cgcatttgtgttttaataaaagaatctggaagataaatagtcttgaagagagacaaaggaaggaaaatttaaatccttagattcaagcagaagaattccatgtggaaggtttgggttgttgttgttgttgtttggtgtgttttttgtttttttgtttttttgtttttttttgagatggagtctcgctgtgttaccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggggatctggggaaggaccaacccatgccctgccaagcctggagcccctgtgttggggggcaaggtgggggagcctggagcccctgtgtgggagggcgaggcgggggagcctggacccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctgaaaaagcaca

SEQ ID NO: 276529 - DNA, 2426 bp, Homo sapiens
gctgcttctccagccagaccacggcaggcttcccaaaggcacgctttggctctctcattcaccaggagaataagccaatgcatggcaagcactaaatcttagatcctgaagactcagccctcgagcaaaagacatgcacctccccactcaccgggccctggaagaggagggtgctcctcttagaggcccctggaggccaggcgtgcctcagaggggcctttcgaggcagctgggaggcagatcctcacactctgccctcctctcccccaggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctgaaaaagcaca

SEQ ID NO: 276530 - DNA, 1965 bp, Homo sapiens
cgcatttgtgttttaataaaagaatctggaagataaatagtcttgaagagagacaaaggaaggaaaatttaaatccttagattcaagcagaagaattccatgtggaaggtttgggttgttgttgttgttgtttggtgtgttttttgtttttttgtttttttgtttttttttgagatggagtctcgctgtgttaccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctgaaaaagcaca

SEQ ID NO: 276531 - DNA, 1191 bp, Homo sapiens
  misc_feature (32)..(32): n is a, c, g, or t
cctggtaggcctgctacacagtcttgcaacgnccctcgtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctgaaaaagcaca

SEQ ID NO: 276532 - DNA, 2936 bp, Homo sapiens
cgcatttgtgttttaataaaagaatctggaagataaatagtcttgaagagagacaaaggaaggaaaatttaaatccttagattcaagcagaagaattccatgtggaaggtttgggttgttgttgttgttgtttggtgtgttttttgtttttttgtttttttgtttttttttgagatggagtctcgctgtgttaccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctgaaaaagcaca

SEQ ID NO: 276533 - DNA, 2768 bp, Homo sapiens
gcccgattgtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctgaaaaagcaca

SEQ ID NO: 276534 - DNA, 1883 bp, Homo sapiens
cgcatttgtgttttaataaaagaatctggaagataaatagtcttgaagagagacaaaggaaggaaaatttaaatccttagattcaagcagaagaattccatgtggaaggtttgggttgttgttgttgttgtttggtgtgttttttgtttttttgtttttttgtttttttttgagatggagtctcgctgtgttaccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctgaaaaagcaca

SEQ ID NO: 276535 - DNA, 865 bp, Homo sapiens
gctccctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccaggtgacgtcagaagcagcccgcccctgcctggatggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggtgagatccccatctcatccctcacctgggctccccagtgtttccccgagttctttttctgggcccccaagtcttctctgaatccctctaccatcatgaataattcttc

SEQ ID NO: 276536 - DNA, 2552 bp, Homo sapiens
gctccctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccaggtgacgtcagaagcagcccgcccctgcctggatggtgcgccctgagtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctcttcctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagatcctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtgtggcctctgccaggaatggt

SEQ ID NO: 276537 - DNA, 2519 bp, Homo sapiens
gctccctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccaggtgacgtcagaagcagcccgcccctgcctggatggtgcgccctgagtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccaggttaacttgggagggtgactcccttctattcccagcactatgccggggactgtggcaacactgcggttccagctgctgccccctgagccagatgatgccttctggggtgcaccttgtgaacagcccctggagcgcaggttaccgctgcttcaaggcagtgctcttcctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagatcctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtgtggcctctgccaggaatggt

SEQ ID NO: 276538 - DNA, 2418 bp, Homo sapiens
gctccctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccaggtgacgtcagaagcagcccgcccctgcctggatggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctcttcctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagatcctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtgtggcctctgccaggaatggt

SEQ ID NO: 276539 - DNA, 1959 bp, Homo sapiens
actcttgactcaaaagatttatcctaactcctgtgatcctcaaatacatcaaccctcatgatctcaatggttatgtttgccttcccattgaccaccaacagccatatctctctaacctcccctgacctcaatggccccatcactgatgccgtcatgactccagtgaccctcaattctctgatcttagtgtctttgtctctggttcccctgggatcccatgtccttgaccccttggacctgctccctccagcctggtgccctcatcttggcccctcactagcccctgttcccctccaggttaccgctgcttcaaggcagtgctcttcctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagatcctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtgtggcctctgccaggaatggt

SEQ ID NO: 276540 - DNA, 2587 bp, Homo sapiens
gctccctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccaggtgacgtcagaagcagcccgcccctgcctggatggtgcgccctgagtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccaggttaacttgggagggtgactcccttctattcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctcttcctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagatcctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtgtggcctctgccaggaatggt

SEQ ID NO: 276541 - DNA, 2566 bp, Homo sapiens
gctccctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccaggtgacgtcagaagcagcccgcccctgcctggatggtgcgccctgagtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccaggttaacttgggagggtgactcccttctattcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctcttcctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagatcctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgt

SEQ ID NO: 276542 - DNA, 2976 bp, Homo sapiens
  misc_feature (2789)..(2789): n is a, c, g, or t
  misc_feature (2804)..(2804): n is a, c, g, or t
gctccctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccaggtgacgtcagaagcagcccgcccctgcctggatggtgcgccctgagtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccaggttaacttgggagggtgactcccttctattcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctcttcctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagatcctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtaaaaaaaaaacaaaaaaaaaaaaaaaaaaaaaaaaaagaggggggggcgcgcccaaaagattctccccgcggggggccccaggttttggcgcggttccccgcagttttttgtgtgccaaggggggccccataaagggggagctcgaatattatataagccatacgagcacgagtagccccgcactgtttttaacaaacggtctcggggcactgtggggaacanaccatgtgtgtcacngctgtgggggaacccctgtggtgccaacggggacccccttaaacctctccggggggggggggacactactattgtgtggcaacaagaattcccttacaggaaaggattttataaagcctctaaaggggggaaaatcttacaacattttaagaggggttatacaacaggcgga

SEQ ID NO: 276543 - DNA, 2371 bp, Homo sapiens
gctccctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccaggtgacgtcagaagcagcccgcccctgcctggatggtgcgccctgagtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccaggttaacttgggagggtgactcccttctattcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctcttcctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtgtggcctctgccaggaatggt

SEQ ID NO: 276544 - DNA, 403 bp, Homo sapiens
gataatcaaacttttaaaactatagctagatggggtgcagtggctcacacttgtaatcacagcactttgggaggctgaggcaggaggatcacttgaagccaggagcttgagaccagcctgggcaacaaagcgagaacctgtctctattaataattttttaaaataaataaaaattggaggagccaagatggccgaataggaacagctccggtctacagctcccagcgtgaccgacgcagaagatgggtgatttctgcatttccatctgaggtaccgggttcatctcactagggagtgccagacagtgggcgcaggccagtgggtgcgcgcacggtgcgggagccgaagcagggcgaggcattgcctcacctgggaagcgcaaggggtcagggagttccctttc

SEQ ID NO: 276545 - DNA, 697 bp, Homo sapiens
ctcccgcccacgttgccttccgggcccgtgcgctccctggctgcttccccctgccgtcagcccgcctgccgggtggaggcgtctagtggcgtcctgagccccccgggggccgctcagtgacaggggctgccccgagctggagggggatccagcgaccaaaccagaggatgcactgaccgcccctcccccccaggcccaaccctccacctggcctcagtcccggggttcctggcgggctgtgcggggcgggggcgcgtcggcgggggcagcttgcgagggtcgttggcccctggaggccgaggggcatggcgccagcacgtctgagccggtgcccgtgtctgtccgtgtctgtaggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctc

SEQ ID NO: 276546 - DNA, 377 bp, Homo sapiens
tcgaattcaagcttctaacgatgtacggggatactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 276547 - DNA, 1087 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagagctatggaggtggcatgcgacccccacccaactccctcgccggcccaggcctgcctgccatgaacatgggcccaggagttcgtggcccgtgggccagccccagtggaaactcgatcccctactcctcctcattccccgggagctacaccgggaccccaggaggatggttgggccccctgggaacacccatcatgcctagcccttggagaattccaccaaataccgagcgaaacagcatgttcacttattcatgtaacccccaattcgtggacaaggacgcccggtcaggtgccctaagtttcccccgtcttcgtgccccctgtccctgggaaggggcccccagtggtcggcctagaagccgcgaatggggacgccatcacgcaccgttaaacgggatcccgtgtggactcgggtggacatagaacggccttgccgaaaagttccccg

SEQ ID NO: 276548 - DNA, 1796 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagcgtaagcgactgcgtcgactccccccccgcggcggcgtcgggccggaggggcctggcgggcaggccccggcggggcggccggggggccagagcaagaccgtgaccgcggcgggccagtactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 276549 - DNA, 2084 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagcgtaagcgactgcgtcgactccccccccgcggcggcgtcgggccggaggggcctggcgggcaggccccggcggggcggccggggggccagagcaagaccgtgaccgcggcgggccaggtgggggggcggccgcggcatcctttccctctcctcaacctctccccaccccccaccacctcccgctcctatttcaccgtcccgatcccatccgcccccaccccgggacccgcgccccagggcggccttcccatgcatcgcccctcccccgttccctcctgtccccaccccatgtctgcccaggacccagccctgccctgtcccccattgtccctgggggcgggtcccagcctcttccggagctgaactcggcccctgcgcgctgccccctcctctctccgcagtacttactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 276550 - DNA, 1636 bp, Homo sapiens
tgcggtggcctgtgtttagttgttccaggacggccactgtgagctgggtgtgtggcagtgtatgtgtgtcgctgggcgggctgtatgtgcggtggttcccacccttgctgagtgtgggtagctctgcggggtgagacacccaatgtcactgcctgaggctttatggggctatccgcagtcgttccagcagcggggtacacttttgctgtgtggagcgctatgttgagtgtcgctgcgaatgtgtgtggctgggtgtacaacaatgtgggtggccggctccatttgaggttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 276551 - DNA, 1656 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagcgtaagcgactgcgtcgactccccccccgcggcggcgtcgggccggaggggcctggcgggcaggccccggcggggcggccggggggccagagcaagaccgtgaccgcggcgggccagtactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctc

SEQ ID NO: 276552 - DNA, 1418 bp, Homo sapiens
gccgcccaagccctggggtgaccgaatccccgcggggactcgtcatgccgggccgtcgcctccgttgctctcgctctaactgggggcgccttgcccgccgagcctgcacggaggcggccccttcctctctcgccctccgaggcgggggaggggggcggggggggctctgttcgcccctccccggctccctgccgaccttggcgtctccaggaaacgccggagcgcccagcccatcgccatggcaacgcgggccgggccggctcctcttcagggatgattgacgtaggggagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 276553 - DNA, 1482 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagcatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagcgtaagcgactgcgtcgactccccccccgcggcggcgtcgggccggaggggcctggcgggcaggccccggcggggcggccggggggccagagcaagaccgtgaccgcggcgggccagtactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 276554 - DNA, 1264 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaaggtaaggaggctgcgctcttgccgggggtgggatccggg

SEQ ID NO: 276555 - DNA, 837 bp, Homo sapiens
ctcccgcccacgttgccttccgggcccgtgcgctccctggctgcttccccctgccgtcagcccgcctgccgggtggaggcgtctagtggcgtcctgagccccccgggggccgctcagtgacaggggctgccccgagctggagggggatccagcgaccaaaccagaggatgcactgaccgcccctcccccccaggcccaaccctccacctggcctcagtcccggggttcctggcgggctgtgcggggcgggggcgcgtcggcgggggcagcttgcgagggtcgttggcccctggaggccgaggggcatggcgccagcacgtctgagccggtgcccgtgtctgtccgtgtctgtaggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 276556 - DNA, 400 bp, Homo sapiens
gcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagtgagtgcggggccgggggcggggctcggcgtccgcgctcttccgtgggctccggcgcgggcgggcaccgcgcggggcacgtgggcgc

SEQ ID NO: 276557 - DNA, 1746 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagggcccccccggctcccagccgtccccccacaaccccaacgcccccatgatggggcctcacggtcagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 276558 - DNA, 1680 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 276559 - DNA, 2057 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagcgtaagcgactgcgtcgactccccccccgcggcggcgtcgggccggaggggcctggcgggcaggccccggcggggcggccggggggccagagcaagaccgtgaccgcggcgggccagtactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggtagcttgtctcagattccctctttggccttctgccaccacactctccaccctgtggtcttgttccgtccccgcccccatctagccccacctttgagaactgggggcagagcgaggctccaggttctgggctctccctgggagttggggtgatgaccatgggcagaggggatgggactgaagctgggcgctcaagagtcggggaagtagagggaggcagagtcaggtcacaggccccaagaaccccaggtggaaggagggctga

SEQ ID NO: 276560 - DNA, 2357 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggtgaggcccggggcgcggggtagctatggcgacggcaagcgcggcccgcggcgccgcctgacaggtgtgggccccggcggcggcggcgtggagcagcatgtacgccaaggggggcaagggttcggccgtgccctccgacagccaggcccgcgagaagttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagcgtaagcgactgcgtcgactccccccccgcggcggcgtcgggccggaggggcctggcgggcaggccccggcggggcggccggggggccagagcaagaccgtgaccgcggcgggccaggtgggggggcggccgcggcatcctttccctctcctcaacctctccccaccccccaccacctcccgctcctatttcaccgtcccgatcccatccgcccccaccccgggacccgcgccccagggcggccttcccatgcatcgcccctcccccgttccctcctgtccccaccccatgtctgcccaggacccagccctgccctgtcccccattgtccctgggggcgggtcccagcctcttccggagctgaactcggcccctgcgcgctgccccctcctctctccgcagtacttactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggtaaaaaaaaaaaaaaaaaaaaaaaaaaaaaaaaaaaagaaaaaaaaaaaaaaaaaaaaagaaaaaaaaaaaaaaaataaacgaagcgaggagataattatgtgtgcgggcgggggagaaaaagagagaattgaagaaaagagagggacggtgggtacaaaagtgtggttgggcggaaaccacattttgtgggagaaagagggggaaaattgagggggctcccacgaagagaggggtataagtcagagaagaggcgtgacgctttaaaagtgggta

SEQ ID NO: 276561 - DNA, 1524 bp, Homo sapiens
ggcgggaggaggggagcgcgcgtttcccggaacagcccgcgcggaggaaagggaggaaaaaaagccaccctgcggccggggccggagctggagccgccgctgccgccgccgccgcggccgtctggagctcccccgcgcggacgatgcctgccgtgcccgcctggggctcggggcggttggcgctgtacgtttatgagtacctgctgcacatcggtgcccagaagtcagcccagaccttcctgtctgagatccgatgggagaagaacatcacgctgggggagccccctgggttcctgcactcctggtggtgcgtcttctgggacctgtactgcgcggcgcctgacagaagagaggcctgcgagcactccggcgaggccaaggccttccaggactatagtgctgcagccgcccccagccccgttatggggagtatggccccaggtgacacaatggccgcaggctccatggcggctggcttcttccagcccttcatgtcaccgcgcttcccagggggcccccggcccaccctgcggatgccgagtcagcctcccgcaggcctccctggctcccagcccctcctccctggcgccatggagccctccccacgagcccaggggcatccgagcatgggcggcccaatgcagagggtgacgcctcctcgtggcatggccagcgtggggccccagagctatggaggtggcatgcgacccccacccaactccctcgccggcccaggcctgcctgccatgaacatgggcccaggagttcgtggcccgtgggccagccccagtggaaactcgatcccctactcctcctcatcccccggcagctacaccggacccccaggaggaggtgggccccctggaacacccatcatgcctagccctggagattccaccaactccagcgaaaacatgtacactatcatgaaccccatcgggcagggcgccggcagggctaatttcccgctcggccctggcccggagggccccatggccgccatgagcgcgatggagcctcaccacgtgaacggatccctgggctcgggcgacatggacgggttgccgaagagttcccccggcgccgtggccggcctgagcaacgccccgggcaccccgcgggacgacggcgagatggcggccgccgggaccttcctgcacccgttcccgagcgaaagctactcgccagggatgaccatgagcgtgtgatggggcggcagccccgggcctctctgcgggcctaggcttctgcccagcgcccctgctcagggcgaggggctgaggtcacacctcgggcacctggactcctggccaatcaaggcttgcccagctgggaggccccacacgaaagactcttaccattttattaaaaacgcaaggacctcagagacgttcttttctgtatggacccttcctgccatttgtattttgtcccagagagaaaggctctttggggggcccctctccccaggacgtcagggggtggggcccataaataaatggaagctggttttggtttttggta

SEQ ID NO: 276562 - DNA, 820 bp, Homo sapiens
gagttgccagtcagccaggggaagaaggccttgaaacaagaaaaccagcagacacacaagaactcccaaagggttaggaaggaaacagatggaatgtgtgggcctccactctcaggggtctgaggaggagtctacgccagcacagggttgggcaggctgagcacatggcagatgtgtcagaaagcaactgccttttgttctgaaatggtgtttgtcattatttgaggatgttaacatgtccaaatgtccattttgaaatgaattcgtataaaataaaaacattgctgtgaaaagctcacagtccagggtctgtctttccttccttctctcctcccttccttcctttctataaattgtcatgggctgtgaaatgtgagatgctggtctccactcatctggttccagcttctcatctgacagatgtggttcctgagcccagtggccagccagaccttagccaccatcacatgcccctaactgtcctctgccccattttccctgcagatgacatgcaccaggctccccaaccctcaccacaagccctgagggccctggatagcctaggagtctagaaacctgggcctaagattagactggaccaagttgatcctgtttccgccatttatgtgctgtgtgaccttgagcaagtgaattaacctctctgaacctttgttgccttgtctgtaaaatgagaatgataggccgggtgtggtggctcatgtatgtaatcccagcactttgggaagctgaggtgggaggatcccttgagtccaggagttcgagaccagcctgggcaacatagcaagatcccatctgtata

SEQ ID NO: 276563 - DNA, 723 bp, Homo sapiens
gatttttaaagatggtcttttcccaatttgtggaaatgttttaacagaatgctctcaatatttttcgcccatgtgattcttagattcatgtgaatctaacacaacgtatctgatactgttcccaacaggaaccagggtggcagggctagatgtcctctcaccagactgcccagtgaaggtgctgtcactttgatgaattatcaaggctttgtagtgggtcttctactggacaaaggacaaactggagactccctggatcaaatgtgttggtgaggcactgaatctgattgctgaaaggtgattcagctgcaagttaggcatcagtttagggttttctaggcttggcatctaaagggagtgcctgctgtagctgaaaacctcataggccttctcttccttccgaattgttttcaaggccttgggggtacagagacttagagaaaatacatagttgtgcctcagactgatgggcctcatctgtttaatggagaaacaccaagcacactcagtctgggcggaattttagagctccatagtataaccactatctagctacatgtggcaattgagcatttgaaatgtggctagactgaattgaaatgtgctgtataaaatatacacttaatttcaaagacaatatttttaaaatgtaaaatatttcagtaatttaaaaatatggtttaaatattttagatatgttgggttaaataaaatatattagta

SEQ ID NO: 276564 - DNA, 743 bp, Homo sapiens
tccagtaggtcactggccagacaggtgagtatgaaataggacaacactgtattatagctcaggatgcattgataatagaagtttgaagcagcagctgacagacgagtctaagcaataacacacagactagtttgtctctgctcttgagaacagcagcctgcaacccttcaaacaagccataatgtgtgagtcaacaagaagctacatttgattgacaatgccattttaataaagatgttctagagtcaaagaatttggcgtgagaaattgtgcccaggctggggtgcagtggtgtgatcatagctcactgcggcctctgagctcctgggctcaagggatccccctgccttagcctctgaagtagctgggactacaggcatgcaccactgtgcccagctagtttttaatttttttttaaagatggggtctcattatgtttcccaggctggtctcgaactcctggcttcaagtgatcctcccaccttggactccgaaagtgctgggatgtgctcaatattaaatgtcatgaagatactgttaaaataataattgtgctcaatagttgtatctttatactattctgagccttaggtttcttttctgtaaaactgaacaatactaccttctttgcaggggatagcatagtccctggtttacagtaaatgctttcctccaattgaatcaagatatacctctctgctacctccccatctattagaaatgcttgccttctggtaccagaa

SEQ ID NO: 276565 - DNA, 1369 bp, Homo sapiens
ctggtgcccgccttggcctagccccggccccgggacggaagggggcctctggggtggcagcctgggcccagtagagctttgcatctcttggatatctttcccgggcgcagaagctgcggggcttagggagtcgccattgcgctggaaagtcctcccgcccacggagaccccagcaaactccgagtgtcacacagtcgcctctggcgacccgtgcgggccggagccgttcgcgcacaggcagggcgggtgctgagcgtggaaacggggctggaattggccgagccatgcctttccgggatgcccaccgccagtcaaagggttgggggtggtctctgcaccttaagtactaacctgccgcccacgcgcctcctgaccacagcaccccgtcggctttctaattctgtgagctgccctcgtgggcgtggcctccctgtggagctccccatgtgcctccccttggtccagcctgcagctaggaagtgggtcacagcgacggggctgggctgggccaggccaggctccgggagatgtggaattggcgaaacaactgccccagtagtatcctccgcctaggactccaagaggtggcgaattggggcactacgcccgggaaccagggtggcagggctagatgtcctctcaccagactgcccagtgaaggtgctgtcactttgatgaattatcaaggctttgtagtgggtcttctactggacaaaggacaaactggagactccctggatcaaatgtgttgaaaatgttatagtgctgtcaggaagtgctgttctggaatacagaatgtggctgccgtgagtggagtgtgactatgagatagtcgcctgactggagacaatgaagcctcaggccaaggatgctccctcctactcagccctgtttagtgggatttttcagcccactgtaaagcctactgctgcctgtaaagccacctaagtgcatcacttgctggtgttcaccatgataacaacaatttatggggacagaatatgtttctagagctgctggtgccactgctgatgttactgggttccctgaaataaaacaccacagtgcaggctggtctcgaactcctggcttcaagtgatcctcccaccttggactccgaaagtgctgggatgtgctcaatattaaatgtcatgaagatactgttaaaataataattgtgctcaatagttgtatctttatactattctgagccttaggtttcttttctgtaaaactgaacaatactaccttctttgcaggggatagcatagtccctggtttacagtaaatgctttcctccaattgaatcaagatatacctctctgctacctccccatctattagaaatgcttgccttctggtaccagaa

SEQ ID NO: 276566 - DNA, 1166 bp, Homo sapiens
ctggtgcccgccttggcctagccccggccccgggacggaagggggcctctggggtggcagcctgggcccagtagagctttgcatctcttggatatctttcccgggcgcagaagctgcggggcttagggagtcgccattgcgctggaaagtcctcccgcccacggagaccccagcaaactccgagtgtcacacagtcgcctctggcgacccgtgcgggccggagccgttcgcgcacaggcagggcgggtgctgagcgtggaaacggggctggaattggccgagccatgcctttccgggatgcccaccgccagtcaaagggttgggggtggtctctgcaccttaagtactaacctgccgcccacgcgcctcctgaccacagcaccccgtcggctttctaattctgtgagctgccctcgtgggcgtggcctccctgtggagctccccatgtgcctccccttggtccagcctgcagctaggaagtgggtcacagcgacggggctgggctgggccaggccaggctccgggagatgtggaattggcgaaacaactgccccagtagtatcctccgcctaggactccaagaggtggcgaattggggcactacgcccgggaaccagggtggcagggctagatgtcctctcaccagactgcccagtgaaggtgctgtcactttgatgaattatcaaggctttgtagtgggtcttctactggacaaaggacaaactggagactccctggatcaaatgtgttgaaaatgttatagtgctgtcaggaagtgctgttctggaatacagaatgtggctgccgtgagtggagtgtgactatgagatagtcgcctgactggagacaatgaagcctcaggccaaggatgctccctcctactcagccctgtttagtgggatttttcagcccactgtaaagcctactgctgcctgtaaagccacctaagtgcatcacttgctggtgttcaccatgataacaacaatttatggggacagaatatgtttctagagctgctggtgccactgctgatgttactgggttccctgaaataaaacaccacagtgcagctggacggtactgctgccatctcggctcactgcaacctccctgcctgattctcctgcctcagcctgccgagtgcctgcgattgcaggcgcgcgccg

SEQ ID NO: 276567 - DNA, 399 bp, Homo sapiens
atcaaataacaacttttcagtcagtgacagactgcatatacaaaggtggtctcatacgattataatagagctgaaaaaattcctattgtctctaaagaccttccaggaggacaggatgtgaggtggcatcagtggcactgacaatcctgaccctgtgcaggcctaggctaatgtgtgtggttgtgccttagtttataacaaaaaagtttaaaaagtaaagaaaaaataaagaaaaagaaaaatttaaaaatagaaaaagcttatagaaagaatacaaagaaaaaatattttcatactgctgcacaatgtgtttgtgttttaagtcaaacgttattacaagtcaaaaagtttaggtcgggtgtcgtggttcacgcctgtaatcccagcactttgggaggc

SEQ ID NO: 276568 - DNA, 708 bp, Homo sapiens
tttgtctatcaatttttaaatatttttatcaataatcactcaaaaagaacatgaaaagggattgctgccccaaggccctcccaggctgaatgcacagggaatatgcctccagccgtaggtgaggcctccactcactccatctcctcgcccgccactagcatgtcccatcccatgcagctagtcgggaggagtgcggggtcttggtgaggtccatgccagcagaaaacaaaagaccaaaagctgccaccttgaagtttcttacccggtttaatgttttctttatagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccat

SEQ ID NO: 276569 - DNA, 1674 bp, Homo sapiens
gcctccgtcagctccccctcaacgactgcaaaagagcctaaaccaaaatcccctagtttctattgaacactatcgctgtgtgtaccaattcctggactaggtcggcgtaagagaggaagtaggtgaaaaaaataaagaggcgctcccctccacgtgatcccagccctgcctctttagtgaggcacgcggccgggcggctccaaggctgccggctagggtgagcagcggagcgcttgggcttggagtagcaaagaacgcgctctccagagaaagtatagccactgcttagacagccagggaaacgtgtgcggggaagtggaggactcaggctctcgtgcgagagcggagttggacgtgcagggccgctggggtcacgcggagctctcccgcctcccctccgcgtgagctctgggatggtccgcgccgggagcgcgcgcgaggcttgaagcgcgggtgaagcgcgcaggtcggagtgacagctgcgctgccggcccggctgcggtcagcaacgcgccatggacgcagagctggcagaggtgcgcgccttgcaagctgagatcgcggccctgcggcgagcgtgtgaggacccaccggcgccctgggaagagaagtcccgagtccaaaaatcttttcaagccatacaccaattcaatttggaaggatggaagtcttcaaaagatctgaaaaatcagcttggacatttagaatcagaactttcatttctaagtacgcttactggcatcaatataagaaatcactccaagcagacagaagacctaacaagcactgagatgacagaaaagagtattagaaaagttctacagagacacagattatcaggaaattgccacatggttacatttcaacttgaatttcagattctggaaattcagaataaggagagattatcttctgctgttactgacctcaacataataatggagcccacagaatgctcagaattaagtgaatttgtgtctagagcagaagagagaaaagatctgttcatgtttttccgaagcctgcatttttttgtggagtggtttgaatatcgtaagcgcacgtttaaacatctcaaggaaaagtacccagatgccgtgtacctctcggaggggccctcctcctgctccatggggatccgcagcgccagccggccagggtttgaattagtcattgtttggaggatacaaatagatgaagatgggaaggtttttccaaagctggatcttctcaccaaagtcccacagcgagccctggagctggacaagaacagagccatagaaactgctcctctcagcttccgaaccctggtaggactgcttggaatcgaagctgctctggaaagcctgataaaatcgctttgtgcagaggagaacaactagttccaaaacagtgaacgtggaggatgaagatgctgcgtggaggaacatgcaattttattcaatataaacatttgctattttctgcttagaaaccacaccctgaagacgtgctgtctatgcagttatggcacattatatggaaactctcatgacatgaaaaataaatacaactagttaagtataaaatgccaaataaaagtgacacgtacaatgtggtttataaaaataagcttaacatctgagaaaatgtaccaagtggttgtgtgtcctcagatgtgtggggaggatccat

SEQ ID NO: 276570 - DNA, 904 bp, Homo sapiens
ctccaagtggcactgttttgggagctgtctgtaatccaccaagcgactgaactcatccactgcgagttgtggggcagccatgcttctctacaaggatacagataccaagagaaagaacccattctgcaggtggagaaaaagaggactctggggtctgttacctgagtttccagctgtctcctgagccaggttcagcaccttcctctgtctcgtagcaaatcagcccctggattcagcgagatatcctgagagcctacaagtaactttggctgcccacctgtattctttttcttatttgttattaatttatgttgagactccatctcaaaaaaaaaagttacagaggatgtgcagaggtcatatgcaaatactgtaccattttacagaagggatttggacattcatgaatttcgatatccaccagggtcctggaaccaatcctcctcggataccaagggatgactgtcatttctttagacgaaaggtgccacccacaataaatagaataaggataactgggactttctgtatacagagacctctagtaaaatgctggcccggaccccatccaccgctcaccttctcgggacaaaattcaggattgctctgacgcaatttgctaggtctgcccttgataacagcatagcaaaacattgttatcaccatcacaaagaggaagtaactggtgtgcatgagatgcaaatttattaatgaacggtcatcctaaataaagaagagaaaaaaaatcagaaacatctgctctgagtgactgaaaggttttaatgctgggttttgagagacaggattgacagcctccagacttgccacaacttttcttcttaagctgcaagaggaggtttctccttttgcctcctaaatgaccaaagctgggtctcattaagtg

SEQ ID NO: 276571 - DNA, 711 bp, Homo sapiens
gcttgcgactgtaatcccagctcctcgggaggctgaggtgggagaactgcttgaacctgggaggcggaggctgcagtgagccaagatagtgccactgcactccagcctgggagacagagcgagactccatctcaaaaaaaaaagttacagaggatgtgcagaggtcatatgcaaatactgtaccattttacagaagggatttggacattcatgaatttcgatatccaccagggtcctggaaccaatcctcctcggataccaagggatgactgtcatttctttagacgaaaggtgccacccacaataaatagaataaggataactgggactttctgtatacagagacctctagtaaaatgctggcccggaccccatccaccgctcaccttctcgggacaaaattcaggattgctctgacgcaatttgctaggtctgcccttgataacagcatagcaaaacattgttatcaccatcacaaagaggaagtaactggtgtgcatgagatgcaaatttattaatgaacggtcatcctaaataaagaagagaaaaaaaatcagaaacatctgctctgagtgactgaaaggttttaatgctgggttttgagagacaggattgacagcctccagacttgccacaacttttcttcttaagctgcaagaggaggtttctccttttgcctcctaaatgaccaaagctgggtctcattaagtg

SEQ ID NO: 276572 - DNA, 174 bp, Homo sapiens
gcaggtgatctaaggatcccgagggaacttttgctgaggttttctctgaggtttttttgatgctttataggaaactattttttaaaaaaagccatttcccacccaaggacacagtggatgtgttttccctgactccagcagggttaccgatgctcgacattctgtcatcatggt

SEQ ID NO: 276573 - DNA, 4694 bp, Homo sapiens
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttggccaa

SEQ ID NO: 276574 - DNA, 4838 bp, Homo sapiens
  misc_feature (4707)..(4707): n is a, c, g, or t
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttggccaaaaaaaaaaaacancaaaatgtggggcgccgagaccacaagatttttaaacactctgtggccgcgccagaatgatgacaggctacaggtacagaaacggcataagagtgggttcccaaaaccggcagggtggacaccgagtgtgg

SEQ ID NO: 276575 - DNA, 4806 bp, Homo sapiens
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttggccaatgtggtctccttatgaatattaggaaacgaagagggccccggaaggcaaccaagggcctcgtgttgcaggtttttctcgagacagcctgggcaacagagcgagatccgtctc

SEQ ID NO: 276576 - DNA, 4680 bp, Homo sapiens
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagaagtgttgcagtggctaccgg

SEQ ID NO: 276577 - DNA, 2004 bp, Homo sapiens
cgcccaacgccgggagcgaggcttgtagcccttgcggtcgtatttcacaacaggcaccgcatactgaatgggctcagagcccaaggcctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttggccaa

SEQ ID NO: 276578 - DNA, 4679 bp, Homo sapiens
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttggccaa

SEQ ID NO: 276579 - DNA, 4438 bp, Homo sapiens
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagcggatcaggctgatccgcttaagggaaaatagtttaggagaaaccagcttttactgtttttgaaaaattagcttcaccctgtcaagttaacaaggaatgcc

SEQ ID NO: 276580 - DNA, 4208 bp, Homo sapiens
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaattagccgggcatggtggcaggcgcctgtaatcccagctactcaggagactgaggcaggagaatcgcttgaaccagggaggtggaggttgcagtgagcccagattgcgccactgcactccagcctgggcaacagagcgagatccgtctc

SEQ ID NO: 276581 - DNA, 1335 bp, Homo sapiens
tcagaaaaacctcagagaaaacctcagcaaaagttccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttggccaa

SEQ ID NO: 276582 - DNA, 1313 bp, Homo sapiens
gcggccgcctactactactattaaattcgcggccgcgtcgacgagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttggccaa

SEQ ID NO: 276583 - DNA, 4063 bp, Homo sapiens
  misc_feature (4002)..(4002): n is a, c, g, or t
  misc_feature (4010)..(4010): n is a, c, g, or t
  misc_feature (4013)..(4014): n is a, c, g, or t
  misc_feature (4019)..(4019): n is a, c, g, or t
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagtanccatgtcnccnnggaanaggatccgttaaaaaaaaaaggggcgctaaatccccgggcccta

SEQ ID NO: 276584 - DNA, 1225 bp, Homo sapiens
cggacgcgtgggtcgacccacgcgtccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctgggagccaccaggtgggaaaagcgcctctgccagagtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttggccaa

SEQ ID NO: 276585 - DNA, 3716 bp, Homo sapiens
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtccgccaccacacccagctaattttggttattttcagtagagattgcggtgtgtgttt

SEQ ID NO: 276586 - DNA, 3946 bp, Homo sapiens
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggccttgccatatgcaattgcatatggcaaggccaagtggaggatgagagggcggtgtcccaggctgagcagacagccagagggaggagtacttggtcaggctgagggactgcgccagctgaaaggtggaggcaagggagcagaggccagcaggggctgcctggagcctggggactctaccccaaccctagcagcgggaagagagggggcggggccctcacctgctcaaactcgtcagtgatggtcttgggctcctcgtgcctctggaaccacatcatgtacttggtgtggaatcgccatgactgttctttagggcc

SEQ ID NO: 276587 - DNA, 3443 bp, Homo sapiens
  misc_feature (3406)..(3406): n is a, c, g, or t
  misc_feature (3421)..(3421): n is a, c, g, or t
tccaagctgaattcgcggccgcgtcgaccacgccggccctgggcagtgacggggttcgggtgaccatggacagtgcgctcaccgcccgtgacagggtgggggtgcaggatttcgtgctgctggagaacttcaccagcgaggccgccttcatcgagaacctacggcggcgatttcgggagaatctcatctacacctacattggccccgtcctggtctctgtcaatccctaccgggacctgcagatctacagccggcaacatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaagccaccaagaagctgctgcagttctatgcagagacctgcccagccccccaacgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaagaaactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctaagcatcgtggccagcgtccttcatttgggcaacatccactttgctgccaacgaggacagcaatgcccaggtcaccaccgagaaccagctcaagtatctgaccaggctcctcagcgtggaaggctcgacgctgcgagaagccctgacacacaggaagatcatcgccaagggggaagagctcctgagcccgctgaacctggaacaggccgcgtacgcacgaaacgccctcgccaaggctgtgtacagccgcacttttacctggctcgtcgggaaaatcaacaggtcgctggcctccaaggacgtggagagccccagctggcggagcaccacggttctcgggctcctggatatttatggcttcgaagtgtttcagcataacagctttgagcagttctgcatcaattactgcaacgaaaagctgcagcagctcttcatcgaactcccgctcaagtcggagcaggaggaatacgaggcagagggcatcgcgtgggaacccgtccagtatttcaacaacaaaatcatctgtgatctggtggaggagaagtttaagggcatcatctcgattttggatgaggagtgtctgcgcccgggggaggccacagacctgaccttcctggagaagctggaggatactgtcaagcaccatccacacttcctgacgcacaagctggctgaccagaggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgcttcgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgtgtgcgcagagctggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcttggaccatgtgcgcacgtcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcagggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccagggcatcacgtttgcaggaaagccacggcagggatggcaccattgacttcncacccggctcggagntgctcttcaccggccagcggct

SEQ ID NO: 276588 - DNA, 1329 bp, Homo sapiens
tagctcggtttccagttccatttcacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcaggactctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgccacctgtgcctgccagcttccgcttc

SEQ ID NO: 276589 - DNA, 4780 bp, Homo sapiens
gctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagtgagaagggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcaggactctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgccacctgtgcctgccagcttccgcttc

SEQ ID NO: 276590 - DNA, 2999 bp, Homo sapiens
gctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagtgagaagggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtga

SEQ ID NO: 276591 - DNA, 4477 bp, Homo sapiens
gctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcaggactctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgccacctgtgcctgccagcttccgcttc

SEQ ID NO: 276592 - DNA, 4542 bp, Homo sapiens
gctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagtgagaagggggctgggggtcgcgctcgctagcgggcgcggggggtcttgaagatggggtcatcggctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcaggactctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgccacctgtgcctgccagcttccgcttc

SEQ ID NO: 276593 - DNA, 4716 bp, Homo sapiens
gctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagtgagaagggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcaggactctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgccacctgtgcctgccagcttccgcttc

SEQ ID NO: 276594 - DNA, 3933 bp, Homo sapiens
  misc_feature (39)..(39): n is a, c, g, or t
  misc_feature (42)..(42): n is a, c, g, or t
gaaaagaaaaatacttaggctaggtacgaggccgggtgntgntcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcaggactctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgccacctgtgcctgccagcttccgcttc

SEQ ID NO: 276595 - DNA, 4702 bp, Homo sapiens
gctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagtgagaagggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaaggcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcaggactctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgccacctgtgcctgccagcttccgcttc

SEQ ID NO: 276596 - DNA, 2065 bp, Homo sapiens
gctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagtgagaagggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggccaggctcagcactgtggaagcagcaggaaccaaaaaagatctcatccctaaccccccagaacttatattccagatgggaaaaccagtagcaaagatgcagccaaataaacaaggaaataattccagaaagtgacagttatcatga

SEQ ID NO: 276597 - DNA, 2264 bp, Homo sapiens
gctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagtgagaagggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgggtatgctgccagtggggctggtttctgtgggttccaaga

SEQ ID NO: 276598 - DNA, 2774 bp, Homo sapiens
gctagttctagatcgcgatctagaactagtgtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcaggactctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgccacctgtgcctgccagcttccgcttc

SEQ ID NO: 276599 - DNA, 1720 bp, Homo sapiens
gtgaggtgactctacaggatctttaaaggcgagccgggtagtggcggagtcataaggtggtgggttggtgtcagaagagacccaggacaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccacgttcagtgtgttgagtgacatggctctcttcattctgcaaagagggcagcagggaggaaatgagtgaatccaggagtggcccccctccacgagggacctttccagcacagggtttgatctgtgtgtatcacaggggagatgggagccatggaaggttcttgagcaagatgggggtgggggtggggtgggctgtggattctgctgatgtcaggactctttgccgacctgatcaacactcacccggctgctcctgccgccgcctcgcctcggagccgggagaccagcttctcacttcctcgcctgatagactcacggatcttggagagtgagctgctgcggcgaagggcctggggaggggccggggatgctgctcagtcccccaggcccatgcagtccccacgcccaccccaggagccgaagcacagcccatcctcacctgttctgcgtcaccagctgtgcctgtgttgggggcacctagggggaaagatgggggacactgagatggggacatagagaagccaccaggagggaagacagacaggggctaggggctcaccgagaggggcgggtaggtcctccttgtggaggatttctttgtacagctcttccgcttgttgatacttgttctgtttcaggtaggctgaggcctgcggagaagggagtgtctgggaacttttcggaccccagttcccaacactgcatccagtcccgcctttttttttttttttgtagagacaggggtcttggtatgttgcccaggctggtcttgaactcctagcctcaagtgatcctcctgccttggcctcccaaagtgttggggttacaagcgtgaaccaccacgtctggccccactttctaatgtgctgacctggccgtatccttcccctgcctaaagccttgccctggggcagagtgggtttggagctcggccttacttcctgccctggggatggaggacaggcagcctcctgtttctgagcctgtctgctgtactttgggctggtggcatggcctcggtgcctcagtcttcccacacgcaaagtggagcgacagctcccacctcatagggacgctataagaactagcgatgtggggaccgggctaagaggggagccggccacagtgagctcaataaatgtctgctgctgccacctgtgcctgccagcttccgcttc

SEQ ID NO: 276600 - DNA, 493 bp, Homo sapiens
acactgtccccgctggacatctaccccaagatcctggacttccaccccgtcaccatggcaaccttcaccatgacgctggcacgggtctgcctctgccctatggtgagtgggagaggctagggctggggccgggaggggagatgggggcaaggggccgccctccttccttggcttcccccactgctcaggcaggagagctttacagcgaagaggctgggttcgggattcagacagacttaggcttgattctgcttctctgtgggctcgactctcaagcctcagttttctcatctgtgaaatgggaatgtatcctccctgatctcccagggtggttgagaggattgagagagagaactggggtaaaccacttaggtcgcccagggcctggcacaggtaggcgcttagtcagcatcttagcatcttgccgagtacgtggtctggctgtgacccaggtaagtgagccttcctctccgtctccgtctctgtaacacgt

SEQ ID NO: 276601 - DNA, 696 bp, Homo sapiens
tcaacatggccctggagctctacatggacctgctgtcagcaccctgccgtgccgtctacatcttctcgaagaagcatgacatccagttcaactttcagtttgtggatctgctgaaaggtcaccaccacagcaaagaatacattgacatcaaccccctcaggaagctgcccagcctcaaagatgggaaatttatcttaagtgaaagttgctgatcccaaagataacaggggaggaagtttcagctgagaagatggagcatgcagtggaagaggtgaagaacagcctgcagctctttgaggagtattttctgcaggataagatgttcatcaccgggaaccaaatctcactggctgacctggtggccgtggtggagatgatgcagcccatggcagccaactataatgtcttcctcaacagctccaagctagctgagtggcgtatgcaggtggagctgaatattggctctggcctctttagggaggcccatgatcgactaatgcagttggccgactgggacttttcaacattggattcaatggtcaaggagaatatttctgagttgctgaagaagagcaggtgaccctaggcgcagcctgtcccgcagggcctggctggcttagcaatctgagccaccttccttaaaggaaatgttaaaaaaacaactgttctttgcctaataaagaactggaacaacca

SEQ ID NO: 276602 - DNA, 921 bp, Homo sapiens
tcaacatggccctggagctctacatggacctgctgtcagcaccctgccgtgccgtctacatcttctcgaagaagcatgacatccagttcaactttcagtttgtggatctgctgaaaggtcaccaccacagcaaagaatacattgacatcaaccccctcaggaagctgcccagcctcaaagatgggaaatttatcttaagtgaaagttgctgatcccaaagataacaggggaggaagtttcagctgagaagatggagcatgcagtggaagaggtgaagaacagcctgcagctctttgaggagtattttctgcaggataagatgttcatcaccgggaaccaaatctcactggctgacctggtggccgtggtggagatgatgcaggccagcagcacagcgatgcctttgcccaggtgaaccccctgaggaaggtgccgggccttgaaggatggggacttcaccttggctgagagatttagtctcttactggttatgtatgctgcacctgaggagtagcagcactgccaaggacactgagtgtcttgtctgtgcagagcttcacatgaagctggagagaagggactggggcaagagggaaagataaaaaggggcaaatggctctcctcacctggacccacaggggtataccaaaggtgccacggatgcagtcggcatgccagcccaggtactcatgaacacgggcacgagcctgcaggtcagatggataccagtggtccggcgtctggtacttacagctcagaaggcaagctaaggttcagagaggctgtgatcccttcaaggccactcagtccacagcattctctggtggcagacgctgcaggaggaggatctcactctgttgccctggctggagtgcagtagcacgatcatggtcaccgcagtctcgactttcctgggctcag

SEQ ID NO: 276603 - DNA, 484 bp, Homo sapiens
acttttagtagagacggggtttcaccgtgttagccaggattgtctggatctcctgacctcgtaatccacccacctggcctcccaaagtgctaggattacaggtgtgagccacggcgccctgaggactggcagacccatctgactttcttggagtagaggaggaagaggaggaagaagaggtgcaggaggaagaccagggtgtggctgacatctagctggatgcagtggatgattctggaggacctcttgcccttctccttcatgacctgtagggcagggccaagaggaggaagcagcctcagaacagacaaaagactccctgccccaaacggcagtcatcccacagtcagcacttctggaaggaaggaaggaaggtttccttctgcagaaagctcctttttaccttgtttctgacaccagggagggtcagcagagcccagcgcacctgtggtgcctgagttaccatctatgcccaggatgtgcg

SEQ ID NO: 276604 - DNA, 298 bp, Homo sapiens
tgtgctgctaatgtcaacaggtacctgctgattagtcgggagggctcagaagcttccaggggtcccagagattggctggaccctgggcctgttgctcaactccctcctgaatcttcttctgggctacctctctgtcacctgggccatcccctatcccctgttccttgctctgtcacacacttctcactcgttccccaggcccatcccttgcctccccatccctgctctgtgccttttcctgtctttgtctccttccttctcgctgccctgtccctctgtcactcacattcccctttgt

SEQ ID NO: 276605 - DNA, 572 bp, Homo sapiens
cagtcggcactcaaccacctccgcccgagcgcccactctgtgcttcgtgctgggaaacaatgaagacacaccgggctggcctctgggggctcagaagtgcgctgggcgagacatgcttctcaggcctccgggagcattctgagcacgtactcggggagggcaggtccccacccacctgcccggaggaccttgctgggagcaggcatggcatggggcagaagggaaacctacgcggccccacccccactgcgctcccaactaaccaggctttcaataatcccacactaaacacctgctccccggaggtactgcggccctgggcagcgcccagctcaggggggacagggcgggggcggggcggagcctcaccttgaggatctcattggagccgaagccggacagcatgagggtgtccctctccatgtccaggatggcgcaggccaccagcagggcaggtgagcccaccccttcaggcctctcgcccaaactggctggcccacctcccacagccgaaggacatccgggaaggggaattccctcttgaaccagatgagcagccaccggaaacagaa

SEQ ID NO: 276606 - DNA, 241 bp, Homo sapiens
gtaacaaacctgcacattgtgcacatgtaccctaaaacttaaaatataataataaaaaaatatatatatatatttttttggctttgtgagccagacaatgggttgtagtttctcagctctgctgttgcagcatcaaagcattcatacacagtatataaatgaatgggcatggctgtgttccaataaaactttatttacaaaaagaggcagcagactagatctggcactccaggctatagtt

SEQ ID NO: 276607 - DNA, 6071 bp, Homo sapiens
  misc_feature (2311)..(2311): n is a, c, g, or t
  misc_feature (2833)..(2833): n is a, c, g, or t
  misc_feature (2866)..(2866): n is a, c, g, or t
  misc_feature (3623)..(3623): n is a, c, g, or t
  misc_feature (4655)..(4655): n is a, c, g, or t
  misc_feature (4821)..(4821): n is a, c, g, or t
  misc_feature (5000)..(5000): n is a, c, g, or t
  misc_feature (5638)..(5638): n is a, c, g, or t
  misc_feature (5672)..(5672): n is a, c, g, or t
  misc_feature (5725)..(5726): n is a, c, g, or t
  misc_feature (5729)..(5729): n is a, c, g, or t
  misc_feature (5776)..(5776): n is a, c, g, or t
ctcgaggcggccgtctcgctgggccaccgcagcctccgccacccgagcgacggcgcccgtccggatccgtagcgtttcgcggacgccgggacaggcggccccccgcggcgcaccccgccctacacgtccaggacgtggttgagataggagatgtagcagatggccaggcgcaggatctcgatcttggagagcttcttgtccgggggcagcgtgggcagcaatttgcggagctcggcgaaggccaagttgaaggcttccacgcggatgcgctcgcgggtggcgtgggccgagcggtacttggccgtggcgcgccggcggcggcgcttctcctcgcggctcagctgctgcgggtgcgggtagagcgcggctcggctgccgcccttgccgtcgccctcggcctcctccaccggctccaggtccgacacgctgccgagcaccttggtgtccgtgccgcccagggactccggatccgagtgcgccgagctgggatggtccgaatctgctgcttggtccggactcagcatcattttggaggctgaggaggggtcggaaaattaatcagtaaaaggaatcagggtattttgctggaaggatggctgccgaggcctaccacgccggtcctcccagcggacgcgcggcccgggccccctccccacagcaggccggcgcgcgacgcgggagggcgccgataggatctggcccgagggcgcgagccctgcgcctcgccctggcgcgggagccggcggggacgcggttgacccaggccgcatactagactggacacctcgacttgcagacggccacagcgggcctgtggccctgggcctggggaacaaccgcaggcctgtggggtcgcgactgggtttttgtgcctcttccggccaaatgccaaccgcgctattcctcctccctcccttcgtccccttcccggacaaacgagcgatttcgaacaacgaatacatctgggttttcacgggggcggggagacgcggggtgcacttctcgccccgagggcctccggcgaagcaacccggcagccgcggcgcccgagggcctggcgctggtctgggctgcgccgggggcgcctggctctggggtgcggccggtcaggaatccccatcctggagcgcaggcggagagccagtggctgggggcgggaaggcttcttggacccctcgcgcttctccgaaatcgtaaagaaatgactaaacaaacgtgggggagcctttaaaaagaaaattgactccgatgccctcgcaggctcccggagcaccatctgtcacgcagacagccacacacataggggacctagggacacggcgacgtgggatcagacaatgcgcccggcagtctggcgaccaccttgcgggaaaatgccggcagccgggccgctgagggaggagaggatgcagagggaagggaagagaagggaagggcccggggcggggcaggcggggactagcgggtgcagcgcgtgttgtcccggcgggagctgcatctctgccggcaaagttcgggcgctcccggaaccggagctcggcaggctgcagctgtccccgggtggcctggccaagtccgggcatgtcggtgcttagccttcctctaacttaactgtgccctcttggaaacgccacctggccaggcttctctggggcgcctggagcactggcccggactgtgcgccttctgggagggggccgctcagaaccgctgggcttccgggtaattcgggcttcgagaaagggcccggcaggaggagaaaggcccctgcaggggctgcacgcaccgcccctgggcgtcgggagtgaggaccaggctgagaactcggggccccggcgtgggcagcctccgcgacgctcggcacgggagaaatccgcgtcggcgacgtataggagcgtttgcttctagagaaacaaaagcaaggggatgggtgatcggttcccagcaccgcacttgcagaggagcgaattgggccaaaacagctttaatttccctgcgaggaaatcaggtcctctacggcaaaataaaaacaaatgctcccagtgagctgcatgtgactccctacgggcttttctcgggtacgtttatgagtagaacaacttgcacctacacagtcagcttgaaagggcagaaataaatagacgagtaatggaaaatcacaataagccactaaatagttgtagttctggtaaaaagttcctgggttgccctcaaagcacattaaattctcctctagatctttaaaaatattcataaatagtatgccgtgtatgcgttttatctctttatggaatgaactgcatctataganacagtatgaataatctaacttatttcaagctgaaaaaaattatttaaaggagtcttaccttgcaaaagcctttttgataatctgttctccaatctttagagttaaaattccaaggaatagcgaggggagattccggaaaatattaaaagcagcaaatatttattacattcaaaaatgaaaaagcagctgtcatctcgctggtgtccgcagcgagggacaataatatctcaggatgtagacgatatgaatgattgttcacttagttgatagattttttaaaaaacgctttttccttttaattgttctcaaacattgcaagaaattcgttgatgatttttttaaacgatgtgttgaaaagtctcgtgccttttttcctcttctaggtctctaaaaataacaaaagagatgcagagataaacacaatcacatcaaagggctgattcctccactttctaatagcggaataatcaataagaaagatggttaagataagattccgctcctatcgtatgcctttctttnccttaatacggctgagcagaaactgggaagtgnaggacagagatgtgatcttgctcagaagtgattttttttttttttttgagataaggctttgttcagctgatatctccccagttcccaggaacacaatactgtaactaggagctaaggttgcctcttcctcttccctcacttacttgtatgttgtataaatagacacctattttccagtttcaaagtctttcaaggtttggctatatcccccgtccccagcccctcttctctttaccttgtagcaaaatatatatagtcagtggcttggagatgcttggagaaaggttggtgaaaagtgaacgtctcctggagtaacagtgacaaggaagcagagaaagacgggaagagggtgggagagccagagcaaagaggcagagatgcgtgtgtggcttctgggctctcctggtaccaattgattcagcctggagatggtggaagagataaaggcttaggaagggggatggaatttttttcccctaaattgatatttaatgggaaatcctattggacagaaacctggacatgagtcacttaattggacttgacatctgtcacagtgtgggagttttcacagcccaaatattttagcagatcagattcccactgaatctgtgccataaaatataacaattgaaaagcagttcatgatagaaatcttagcctctaaacagtatctagccgtagtcaggctatttctcttttccagattattgatgaaatatttaagtacaaataaacaatatattgactatcaaanaattcccctggcatattacaaagccaccactttcccttaatatttagaaaaatatttgtgtccagaacatggaaatatatactatataagatgctgcaataaagtatttagacatgcaacagccaacatttattagagatcatttacattttaaaagatacttcagtaaggtttgattaagcatattaacatttttgagaaatgatctgctatgagactaacttatcaatagatggtaagaacctttcaatagattaagccattggtggaactagaaagagaatccacatattcacggaccacgacatgagataattctacttttctgtatgtttgtttttctctccacccactcattcattcaagctgaaatatgacatgctacatgtgttgattattgcacttcattcttgcccatcttaacatgctaatatattgtactgcgtggcagtgcttgtgccaagatgtaaacacaaattaccagtgtgtcccagtacataatgcctttgccttacatgatcccatggccctgaatttgtataccttataataaaaaataaaatctagttcaattattttgccactttatgaagatactcatagttaatatcaataacatattatttgtgattattttagcttgttttgatcatacaagcttaaagaaataaaagagcattacagccttactcccaccccgccagttcctaggggaacatttgtggagagaggagtcctcacttgtcttccttaattttgccctaaaagcagattttatcaccaggggaggcacattgagcagcccacccctgggagtgaccctccgggtttttcatggcttccacaagtactatttgcctttgcccacatttttgctcctttgagagattcctggaccacaatggggcaggggtcggggaaaggagggagtgcctccaacaaataagggcaccaacactccccagccttgcttctgcctaaccccagcacagaggtatattttagatatccccagaacgttaaagtgaaganggaagccggtcccatacaggtggcaatggaaatgggtgagtggataaacaccccaaggtggtgacaatgaagggagaagggaggttttctcactctagttaggaacagccaatgctaagcattcacacacaaccagaagtgtgcacacagatgcacacccacaganacctgtacctcctcccccttcatcatacaagctggctggctctattagaccaccacacatccatactgatggattgaaaaaaactggtgggtctaatcaccatagctctagagtgggcagctgctacagtgggaaaggaccagcatctctggttcccctggtgttggggagtcatgacngggtgtgcctatcagggcaggtccaattctgctatggtgtgtgtgataccagacaaattcccttttatgttcaggcttactcattctataccagcagccagcatacacaaaaattaatgcttacagaagtaagcctgtataaacaggtacacactcagatccatacttagtgatgcctagccacactgtcatagacacagacatggattcacattcacacacacacattctttcttccatcaaagcctccccctcccccacccctttgccttttctaagacctccctggcacagatggcccctccttctgtgctccataagcactcctttcatgtctcccttagagactacatattgtgtaccgtgattcttggttcttggttaccacactggtctctcttcctaggctatgatgcttccaggggaggtctgtagcttatatccccagcactaatgtctgagcttgacacattataggtactcagttcatttatgatgtgactctatgtacagaggtaccccagatatttgtaacatagaaacgcttccactaaaggacacccatggttcagttctatcaattttctttcctgtaaaaatgagaataataatattgcacttctcatttcacaggctcnctatgagacccaatgtatttgaaaatatttgatnaaatagtaagcaccatacaaattatgatattatagactataagagtaatattnnatnatattattaaatgaatggggaggtgataagtagtgacttaaaaagtncggctttgtggctctgtcatatgctagctgtgtgaatttagttgtaagttacttaacctttttggaccttagttttctaatctgtaaaatgagaataatcaaagcatgttatgtaatgttatgtcatgtttttttctgaaggtgaacaagataatatatgtaaagtgcttaaactaatgcctagaactcatgttcagtaagtgttggctatcattattattattattcagtataaatacatattgaggaacagatatatattgacatagaaaaataaacatatccagatatactc

SEQ ID NO: 276608 - DNA, 2081 bp, Homo sapiens
  misc_feature (1)..(2): n is a, c, g, or t
  misc_feature (4)..(4): n is a, c, g, or t
  misc_feature (8)..(8): n is a, c, g, or t
  misc_feature (795)..(795): n is a, c, g, or t
  misc_feature (938)..(938): n is a, c, g, or t
  misc_feature (1045)..(1045): n is a, c, g, or t
  misc_feature (1083)..(1083): n is a, c, g, or t
  misc_feature (1131)..(1131): n is a, c, g, or t
  misc_feature (1588)..(1588): n is a, c, g, or t
  misc_feature (1684)..(1684): n is a, c, g, or t
  misc_feature (1760)..(1760): n is a, c, g, or t
  misc_feature (1769)..(1769): n is a, c, g, or t
  misc_feature (1803)..(1803): n is a, c, g, or t
  misc_feature (1814)..(1815): n is a, c, g, or t
  misc_feature (1817)..(1817): n is a, c, g, or t
  misc_feature (1824)..(1824): n is a, c, g, or t
  misc_feature (1833)..(1835): n is a, c, g, or t
  misc_feature (1842)..(1844): n is a, c, g, or t
  misc_feature (1846)..(1846): n is a, c, g, or t
  misc_feature (1849)..(1849): n is a, c, g, or t
  misc_feature (1862)..(1862): n is a, c, g, or t
  misc_feature (1868)..(1868): n is a, c, g, or t
  misc_feature (1871)..(1871): n is a, c, g, or t
  misc_feature (1874)..(1874): n is a, c, g, or t
  misc_feature (1877)..(1877): n is a, c, g, or t
  misc_feature (1888)..(1888): n is a, c, g, or t
  misc_feature (1895)..(1896): n is a, c, g, or t
  misc_feature (1900)..(1900): n is a, c, g, or t
nncncgangcacgagcttggtgatgaagtccttcagctgcgccacgccctggcgcacggtgggctgcagcggctccatccaagcctccttggccctggaagccggcgtgtccatgttgcccacgttctggactgcctggaggtgacagcaggaaggaccaggttctgctaggtttaactgacgctgctgcactggataccccaccccggtgccgggcacataggtgcagcctgagagtaagcagacctgggttggaaggtcccgcgattcaccaccgacaggatgggcggccttggcaacccccgacccctcgcaggcctgttcccttatccatgagatggaactcggacaaggtggccacaggaagcctttgcaaactgtgaagtgcagtgcctacgtgggcgtgccagtggcctcgccggagccggtagggaacactctgcagtccaggccagggccccggtaggacacccagctgtgcatcccgcccgtggccgcaaggcccgcaccttggccaacaggagcagggtgcggctggtgcgggcgtccgcgtggcgctcccgcaggtggaagagcttgggcgacatgatggcgggagagaagaagcgcaggcacaggaagctggtgacggcgatgaacggtacattctggaggggtgcggaagagcgcgggctgggagtcccccagaccagggctcctggcagccccctccccttaggctccgtccctgaccctcgccgggacacagcctccctggtcctccccagcgctccctggttccccaccgctcttgcncgccctcgccccagcccagtccaacccggcccagcctagcccagcgggtggagggcgcacctcgtgctgggcgccggggaagcgctcgcgcacgcgccggaagagctggcggaaggtggcgcgcaccacggcggggcacgcgngaaccgagcggctgagcgcgctcagcagggcccccaggtgggcgcgcagcgtctgcgcgctctgctccagcacctcggcctcggtctgcgggcggtgcagcccggancacctgcgtggaacggggcgggttggcagaggaggtcncggtcagcgccagggccacgacaggaacagtggctctcacagcagccnggacacggacacaggggacaatacacgggtgggcagaagcacaaacacacatgctgacagggcctgatcccaacccgctgccgctgcaccccgcaacccccggagttacccccggcctcaccctacatccttaacttccactttgctggggtccagctccacgtacttcttctcctcaaacaccttgttgatgatggggcccaggacgccgtgcaggtactgcatcccggccacctggggaccaccgcaggtcacattgatcctgtctcccccagtcccactccagctgcccaccttctcccggcagccgcccttgcaccgtttgcctgccgtatccgcccaggagggggccaggtacacatgcagggcaaactgtttattcatgaatgaatgaatgagtgagtgaatgaatgactagaattcttagcccttgtaatcctagcactttgggaggccnaggcaggaggatcacttgaggccaggagtttgagaccagcctgggcaacatagtgagactgtctctaacttaaattttaatcacacacacattctnttgggggggggggtgcggggcacggagtctagcacggggcccaggctagagtgcagtggcgtgagctcactacaanctctggctnctggttcaagtgagtctcctgcctcagctactcnggaggctgagnnangagaatnacttgaacnnnggaggcnnngnttncagtgagccgagntcgtgncantgnacnccagcctggcnacagagnnagantccatctcaaaaaaaaaaaaaaaaaaaaaagaatgagtctggcccctttttgtctttctctcatcctctttgcctttcaccatgttatgatgcagcaagaagcccctcatcagatactagtgccatgaccttggacttcccagcctccagaactgtgagaaaataaatttctgttctatgt

SEQ ID NO: 276609 - DNA, 2302 bp, Homo sapiens
  misc_feature (1016)..(1016): n is a, c, g, or t
  misc_feature (1159)..(1159): n is a, c, g, or t
  misc_feature (1266)..(1266): n is a, c, g, or t
  misc_feature (1304)..(1304): n is a, c, g, or t
  misc_feature (1352)..(1352): n is a, c, g, or t
  misc_feature (1809)..(1809): n is a, c, g, or t
  misc_feature (1905)..(1905): n is a, c, g, or t
  misc_feature (1981)..(1981): n is a, c, g, or t
  misc_feature (1990)..(1990): n is a, c, g, or t
  misc_feature (2024)..(2024): n is a, c, g, or t
  misc_feature (2035)..(2036): n is a, c, g, or t
  misc_feature (2038)..(2038): n is a, c, g, or t
  misc_feature (2045)..(2045): n is a, c, g, or t
  misc_feature (2054)..(2056): n is a, c, g, or t
  misc_feature (2063)..(2065): n is a, c, g, or t
  misc_feature (2067)..(2067): n is a, c, g, or t
  misc_feature (2070)..(2070): n is a, c, g, or t
  misc_feature (2083)..(2083): n is a, c, g, or t
  misc_feature (2089)..(2089): n is a, c, g, or t
  misc_feature (2092)..(2092): n is a, c, g, or t
  misc_feature (2095)..(2095): n is a, c, g, or t
  misc_feature (2098)..(2098): n is a, c, g, or t
  misc_feature (2109)..(2109): n is a, c, g, or t
  misc_feature (2116)..(2117): n is a, c, g, or t
  misc_feature (2121)..(2121): n is a, c, g, or t
gtccctggaggccagacccctgggtgcggcccatcctagcagtggttctggctgggtctgtcctgggcaggagaggagggtccctggagaggcagtgatggctacagcgtctgtagggagctggggacacttccggccagccatgacaggcccaagcctgctcagctctgcacttctggggatccccttattcctgactctcccccctcccccacctggaagagacctaggccctgcaccctaatgaggaggaccggggtgagggggtgcagagtgtcctggggggggcggagcagtgggaggggccatggggctcaagggctgagcaaatctgaacagcaggcagtggacgtagtcatggggctcaagggcggagcaaacatcaacagctggtttaactgacgctgctgcactggataccccaccccggtgccgggcacataggtgcagcctgagagtaagcagacctgggttggaaggtcccgcgattcaccaccgacaggatgggcggccttggcaacccccgacccctcgcaggcctgttcccttatccatgagatggaactcggacaaggtggccacaggaagcctttgcaaactgtgaagtgcagtgcctacgtgggcgtgccagtggcctcgccggagccggtagggaacactctgcagtccaggccagggccccggtaggacacccagctgtgcatcccgcccgtggccgcaaggcccgcaccttggccaacaggagcagggtgcggctggtgcgggcgtccgcgtggcgctcccgcaggtggaagagcttgggcgacatgatggcgggagagaagaagcgcaggcacaggaagctggtgacggcgatgaacggtacattctggaggggtgcggaagagcgcgggctgggagtcccccagaccagggctcctggcagccccctccccttaggctccgtccctgaccctcgccgggacacagcctccctggtcctccccagcgctccctggttccccaccgctcttgcncgccctcgccccagcccagtccaacccggcccagcctagcccagcgggtggagggcgcacctcgtgctgggcgccggggaagcgctcgcgcacgcgccggaagagctggcggaaggtggcgcgcaccacggcggggcacgcgngaaccgagcggctgagcgcgctcagcagggcccccaggtgggcgcgcagcgtctgcgcgctctgctccagcacctcggcctcggtctgcgggcggtgcagcccggancacctgcgtggaacggggcgggttggcagaggaggtcncggtcagcgccagggccacgacaggaacagtggctctcacagcagccnggacacggacacaggggacaatacacgggtgggcagaagcacaaacacacatgctgacagggcctgatcccaacccgctgccgctgcaccccgcaacccccggagttacccccggcctcaccctacatccttaacttccactttgctggggtccagctccacgtacttcttctcctcaaacaccttgttgatgatggggcccaggacgccgtgcaggtactgcatcccggccacctggggaccaccgcaggtcacattgatcctgtctcccccagtcccactccagctgcccaccttctcccggcagccgcccttgcaccgtttgcctgccgtatccgcccaggagggggccaggtacacatgcagggcaaactgtttattcatgaatgaatgaatgagtgagtgaatgaatgactagaattcttagcccttgtaatcctagcactttgggaggccnaggcaggaggatcacttgaggccaggagtttgagaccagcctgggcaacatagtgagactgtctctaacttaaattttaatcacacacacattctnttgggggggggggtgcggggcacggagtctagcacggggcccaggctagagtgcagtggcgtgagctcactacaanctctggctnctggttcaagtgagtctcctgcctcagctactcnggaggctgagnnangagaatnacttgaacnnnggaggcnnngnttncagtgagccgagntcgtgncantgnacnccagcctggcnacagagnnagantccatctcaaaaaaaaaaaaaaaaaaaaaagaatgagtctggcccctttttgtctttctctcatcctctttgcctttcaccatgttatgatgcagcaagaagcccctcatcagatactagtgccatgaccttggacttcccagcctccagaactgtgagaaaataaatttctgttctatgt

SEQ ID NO: 276610 - DNA, 801 bp, Homo sapiens
  misc_feature (14)..(14): n is a, c, g, or t
  misc_feature (107)..(107): n is a, c, g, or t
  misc_feature (308)..(308): n is a, c, g, or t
  misc_feature (404)..(404): n is a, c, g, or t
  misc_feature (480)..(480): n is a, c, g, or t
  misc_feature (489)..(489): n is a, c, g, or t
  misc_feature (523)..(523): n is a, c, g, or t
  misc_feature (534)..(535): n is a, c, g, or t
  misc_feature (537)..(537): n is a, c, g, or t
  misc_feature (544)..(544): n is a, c, g, or t
  misc_feature (553)..(555): n is a, c, g, or t
  misc_feature (562)..(564): n is a, c, g, or t
  misc_feature (566)..(566): n is a, c, g, or t
  misc_feature (569)..(569): n is a, c, g, or t
  misc_feature (582)..(582): n is a, c, g, or t
  misc_feature (588)..(588): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (608)..(608): n is a, c, g, or t
  misc_feature (615)..(616): n is a, c, g, or t
  misc_feature (620)..(620): n is a, c, g, or t
tgcaaagataaggncaaataaagccatgcaaccctcaccttcaagaaaagactccatggactttgaggccagagagttgctccgaaacagggtgttggtcttttgtnacttggtcataagtaggcgttttccttttgatttggttctaggaggttagtgtgcattggcgttctgttgcctgcttccagcccctattctcctgcctcaggttcattagaaaaaactgtttattcatgaatgaatgaatgagtgagtgaatgaatgactagaattcttagcccttgtaatcctagcactttgggaggccnaggcaggaggatcacttgaggccaggagtttgagaccagcctgggcaacatagtgagactgtctctaacttaaattttaatcacacacacattctnttgggggggggggtgcggggcacggagtctagcacggggcccaggctagagtgcagtggcgtgagctcactacaanctctggctnctggttcaagtgagtctcctgcctcagctactcnggaggctgagnnangagaatnacttgaacnnnggaggcnnngnttncagtgagccgagntcgtgncantgnacnccagcctggcnacagagnnagantccatctcaaaaaaaaaaaaaaaaaaaaaagaatgagtctggcccctttttgtctttctctcatcctctttgcctttcaccatgttatgatgcagcaagaagcccctcatcagatactagtgccatgaccttggacttcccagcctccagaactgtgagaaaataaatttctgttctatgt

SEQ ID NO: 276611 - DNA, 652 bp, Homo sapiens
ctgagcggaagtacggaccgtgaactggagtggaatcgcgactatgggagctccggggggaaagatcaaccggccccgaacggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcacttcttgaat

SEQ ID NO: 276612 - DNA, 769 bp, Homo sapiens
agtcgatttcgaacgatatgccctcggccgtagcgcctaaccgctaacatttacgtggcagggccacctactcagtgcacctaagttggaaggcaaccacgccctagcgagatagtcggagccaggtaaccttcgcctcgtacacttagtcatgttcagcaattctaagttgtacggactatcctagaaatgcgcatgtcgcctgtaatccaagcctacgtgtggtgcgacagtgtgctagtaagccgtcgagcgctgcatgaccgacacataatagtatagagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcacttcttgaat

SEQ ID NO: 276613 - DNA, 417 bp, Homo sapiens
aaaaaaaaaaaaaaaaaaaaaaaaaaaaaaaaaaaaaaaaaaaaaaaaaaaaaaaaaaaaaagagagagagaacagaaccaacctccagtccggcagacctgaaatcaaatgagaaagtgtgagcaccccgatggaggagccagctggatctcggttgtccttctccgagattcccggtgtcccggcgtttgaggatagaaccagcggatgggaagccgccagcaccgaagacatgacgccgagggggccagagccctttccctcttcctccgtacattacggggagcggcaccacaagcccgatccccgccaagaaaaggagggtcctgagaccccgcccagagccttccacccggcacccccaccactcccggccgcccaatctggctactacagctaaaaccaccctcgtgccg

SEQ ID NO: 276614 - DNA, 377 bp, Homo sapiens
atttttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcaggtttagctgagggggttgaggtgtccaagaagtgctggcaccaagggctgagcgcggggaccctgtgtcctcaattccggggtgggattgctagggggagagtgcgtgtcttcatggttgccgtgggttttatgattgcccatttttctgtcttccgacgtttcccgatcagta

SEQ ID NO: 276615 - DNA, 439 bp, Homo sapiens
agtagagatggggtttcaccatattgcccaggctggtctcaaactcctgagctcaggcaatctgcccgcctcagcctcccaagaagctacattcttttgagcatttactatgtaccaggtactatgctaaacacttttacttcatgattttcagaacaacccaatgaaggtacttcccctttataaatgagaaaattgaggctgcgaggttaggctcttagtgatataattgctctatttttttataagcaaaaaataccacagaaattaatttttagctcaagtgcagcagcttatcatggcccattgcagctttgacctcccagggttcaagcagtcctcccagctcagcctcctgagtagttggaactacatgcctgtgccactatcccgggctcatttgtttttgtagagttaggggtgtcactttattgccagg

SEQ ID NO: 276616 - DNA, 304 bp, Homo sapiens
ctccggggggataagacacggccgaacggagctgaagaagaagctgttcaaacgccggcgggtgttgaatcgggagcggcgtctgaggcaccgggtggtcggggctgtgatagaccaagggctgatcacgcggcaccacctcaagaagcgggctcgataagctatactccggtgtgcatagtaatcataagagtctatacgtttaatgcaaagacttagggtttgggaatcctgcaccacaggatggtacacacatcattgtataattgcagtatgctatcttttttcgtgatatgggatactc

SEQ ID NO: 276617 - DNA, 576 bp, Homo sapiens
ctgagcggaagtacggaccgtgaactggagtggaatcgcgactatgggagctccggggggaaagatcaaccggccccgaacggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggcccttctccaatctttcttctgtaccttcttccctcccaaagacatccctctaggggaggtcagtaggccattaggtagg

SEQ ID NO: 276618 - DNA, 2039 bp, Homo sapiens
cacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagaaagagtttcactatgtaggtcaggctggtctcgaactcctgacctcgtgatccgcccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctgccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcacttcttgaat

SEQ ID NO: 276619 - DNA, 1295 bp, Homo sapiens
atttttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcacttcttgaat

SEQ ID NO: 276620 - DNA, 809 bp, Homo sapiens
ctgagcggaagtacggaccgtgaactggagtggaatcgcgactatgggagctccggggggaaagatcaaccggccccgaacggtgactgtgtgggggccgcgactttgtttcctcaagcgttcctgagcccttttatctcgcacgagatgggatcagtgaggggccggggctgcctggtggaggggccccgggtcgcggcgagcccactccatctgattcgcatctttctccccggcaggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcacttcttgaat

SEQ ID NO: 276621 - DNA, 1321 bp, Homo sapiens
atttttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcacttcttgaat

SEQ ID NO: 276622 - DNA, 3663 bp, Homo sapiens
cacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagaaagagtttcactatgtaggtcaggctggtctcgaactcctgacctcgtgatccgcccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctgccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggtaagtattgttccctccccctcaaatatctcatccaggtttatgaagctccttatacccatcctcttacaatctccttttacaggtgacaaaaatgaggcttacaggttaggccactagattatacaagtcagtcagcgcaggggttttgattcagttcctgtctgctgcttttaggagctccagttagttgaaactggggaatgacccaattgtaccttctcttttcagcattcattttgtgctaaatattgcgcacatcattgtatgtaatctccgtaactccaagttattctcactctgcagatgagtaaactggggaacagaaacattcagcaatatggcacccagctagtaaatgtggaagccaggactcaaattctcactttgcagccagatagcttgcaaagacagttcttcagccctctccttgcccacagaaatactagggtcaggactactaaaatgtctttaatgagagccttgaatcaagtaagcaaagtaggtgatgcccctgaacgggcctagctcctgcacagtcacagtccagccataggacccttgttccaggcagggcagtcgcacatcagggtcctcatctgagaactgaatcagggtcccctgagggtttagaaccctcaagcattctgatagaagctggtaagccctaggcagacctccccgggcaacagcatcccatgtgcctttgtccagcagtagttggaaagagcctgaagaagccacagcccccaggttctgagcatcggcgtgcatgaagtggaggcttgaggcagggtgtccagggcatagaggtgtttggcctgggccaccctccaggaggctattcatgtgggccacagccacaggagaaaagtccacccccagcacatccactgggtgtggagatttggtgtagaggcctgtacataggctggaagtcccacagcccacatccagcactcgcagaggactggcagcctgtgcctcctgcagcaatggcagtaggagcccctggacttcgtcgtatccaaagaaccagtcgaaggtggggacagtgcccaaacgaggctgggcatgcagccgatcccagagacagcggtccgccaggcaactatcagccagtgagcctgtgggcacggttggagggtgtcacttggtctatgtcgccactgcaaaaacgtcgtatatacacactggcgtcttttttttttttgagacagggtctcactctgtgacccagggttgagtacagtagcacaatgatggctcactgaagcctccacctcagcctcctgagtagctaggactataggcgccatcgtgcccggttaattttttttgtagacagggtctcgctatgttgccctaggttggtctcgaactcctgggccaagcgatctgcccgcctcggcctggcaaagtgttagcattacagccgtgagccaccacgcacggcccaccgtagggtttgagaatcacaatttcagggactacactcctgactcacgaggaacccaccttaccctccccactctgcccccaccttgccctctccactctgcccccacctccctacccgcaaaggggcggcacgtccccatcatcaggctcggcaagtggagcattcgacgcagcgcggccatctggagattcgggtaagttcgaccagagaagcttatgtgaagcgtccaccctactccagccggagaggcctgaggtccaggggaagatctgcaaattccgcgtagcgaaaggcggcgtacagcttccccgaactctgcagtcccggaaaaaagaacgcggacacagactatggtaggaacggcctttattggctgcagcgggaagtggaggagggtatacagcgtccgcagacctgaaatcaaatgagaaagtgtgagcaccccgatggaggagccagctggatctcggttgtccttctccgagattcccggtgtcccggcgtttgaggatagaaccagcggatgggaagccgccagcaccgaagacatgacgccgagggggccagagccctttccctcttcctccgtacattacggggagcggcaccacaagcccgatccccgccaagaaaaggagggtcctgagaccccgcccagagccttccacccggcacccccaccactcccggccgcccaatctggctactacagctaaaaccaccctcgtgccg

SEQ ID NO: 276623 - DNA, 2940 bp, Homo sapiens
cacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagaaagagtttcactatgtaggtcaggctggtctcgaactcctgacctcgtgatccgcccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctgccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggtaagtattgttccctccccctcaaatatctcatccaggtttatgaagctccttatacccatcctcttacaatctccttttacaggtgacaaaaatgaggcttacaggttaggccactagattatacaagtcagtcagcgcaggggttttgattcagttcctgtctgctgcttttaggagctccagttagttgaaactggggaatgacccaattgtaccttctcttttcagcattcattttgtgctaaatattgcgcacatcattgtatgtaatctccgtaactccaagttattctcactctgcagatgagtaaactggggaacagaaacattcagcaatatggcacccagctagtaaatgtggaagccaggactcaaattctcactttgcagccagatagcttgcaaagacagttcttcagccctctccttgcccacagaaatactagggtcaggactactaaaatgtctttaatgagagccttgaatcaagtaagcaaagtaggtgatgcccctgaacgggcctagctcctgcacagtcacagtccagccataggacccttgttccaggcagggcagtcgcacatcagggtcctcatctgagaactgaatcagggtcccctgagggtttagaaccctcaagcattctgatagaagctggtaagccctaggcagacctccccgggcaacagcatcccatgtgcctttgtccagcagtagttggaaagagcctgaagaagccacagcccccaggttctgagcatcggcgtgcatgaagtggaggcttgaggcagggtgtccagggcatagaggtgtttggcctgggccaccctccaggaggctattcatctacccgcaaaggggcggcacgtccccatcatcaggctcggcaagtggagcattcgacgcagcgcggccatctggagattcgggtaagttcgaccagagaagcttatgtgaagcgtccaccctactccagccggagaggcctgaggtccaggggaagatctgcaaattccgcgtagcgaaaggcggcgtacagcttccccgaactctgcagtcccggaaaaaagaacgcggacacagactatggtaggaacggcctttattggctgcagcgggaagtggaggagggtatacagcgtccgcagacctgaaatcaaatgagaaagtgtgagcaccccgatggaggagccagctggatctcggttgtccttctccgagattcccggtgtcccggcgtttgaggatagaaccagcggatgggaagccgccagcaccgaagacatgacgccgagggggccagagccctttccctcttcctccgtacattacggggagcggcaccacaagcccgatccccgccaagaaaaggagggtcctgagaccccgcccagagccttccacccggcacccccaccactcccggccgcccaatctggctactacagctaaaaccaccctcgtgccg

SEQ ID NO: 276624 - DNA, 505 bp, Homo sapiens
ggttacggcgtgtgggctgtacaaacaaggtctgatcagcggcacccctcaagaagcggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcacttcttgaat

SEQ ID NO: 276625 - DNA, 731 bp, Homo sapiens
cagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctgccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggttagtacttcctcagcctgtgtctggcagctggcttaccctccagtttggcccaacctccctgctgtccctattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggtgagggaggtggctcattcagggggccactgt

SEQ ID NO: 276626 - DNA, 960 bp, Homo sapiens
ccgaggattagaggataggggatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcacttcttgaat

SEQ ID NO: 276627 - DNA, 3367 bp, Homo sapiens
cacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagaaagagtttcactatgtaggtcaggctggtctcgaactcctgacctcgtgatccgcccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctgccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggtaagtattgttccctccccctcaaatatctcatccaggtttatgaagctccttatacccatcctcttacaatctccttttacaggtgacaaaaatgaggcttacaggttaggccactagattatacaagtcagtcagcgcaggggttttgattcagttcctgtctgctgcttttaggagctccagttagttgaaactggggaatgacccaattgtaccttctcttttcagcattcattttgtgctaaatattgcgcacatcattgtatgtaatctccgtaactccaagttattctcactctgcagatgagtaaactggggaacagaaacattcagcaatatggcacccagctagtaaatgtggaagccaggactcaaattctcactttgcagccagatagcttgcaaagacagttcttcagccctctccttgcccacagaaatactagggtcaggactactaaaatgtctttaatgagagccttgaatcaagtaagcaaagtaggtgatgcccctgaacgggcctagctcctgcacagtcacagtccagccataggacccttgttccaggcagggcagtcgcacatcagggtcctcatctgagaactgaatcagggtcccctgagggtttagaaccctcaagcattctgatagaagctggtaagccctaggcagacctccccgggcaacagcatcccatgtgcctttgtccagcagtagttggaaagagcctgaagaagccacagcccccaggttctgagcatcggcgtgcatgaagtggaggcttgaggcagggtgtccagggcatagaggtgtttggcctgggccaccctccaggaggctattcatgtgggccacagccacaggagaaaagtccacccccagcacatccactgggtgtggagatttggtgtagaggcctgtacataggctggaagtcccacagcccacatccagcactcgcagaggactggcagcctgtgcctcctgcagcaatggcagtaggagcccctggacttcgtcgtatccaaagaaccagtcgaaggtggggacagtgcccaaacgaggctgggcatgcagccgatcccagagacagcggtccgccaggcaactatcagccagtgagcctgtgggcacggttggagggtgtcacttggtctatgtcgccactgcaaaaacgtcgtatatacacactggcgtcttttttttttttgagacagggtctcactctgtgacccagggttgagtacagtagcacaatgatggctcactgaagcctccacctcagcctcctgagtagctaggactataggcgccatcgtgcccggttaattttttttgtagacagggtctcgctatgttgccctaggttggtctcgaactcctgggccaagcgatctgcccgcctcggcctggcaaagtgttagcattacagccgtgagccaccacgcacggcccaccgtagggtttgagaatcacaatttcagggactacactcctgactcacgaggaacccaccttaccctccccactctgcccccaccttgccctctccactctgcccccacctccctacccgcaaaggggcggcacgtccccatcatcaggctcggcaagtggagcattcgacgcagcgcggccatctggagattcgggtaagttcgaccagagaagcttatgtgaagcgtccaccctactccagccggagaggcctgaggtccaggggaagatctgcaaattccgcgtagcgaaaggcggcgtacagcttccccgaactctgcagtcccggaaaaaagaacgcggacacagactatggtaggaacggcctttattggctgcagcgggaagtggaggagggtatacagcgtcctagctcaccaccctccgaaaaagccgct

SEQ ID NO: 276628 - DNA, 3260 bp, Homo sapiens
cacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagaaagagtttcactatgtaggtcaggctggtctcgaactcctgacctcgtgatccgcccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctgccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggtaagtattgttccctccccctcaaatatctcatccaggtttatgaagctccttatacccatcctcttacaatctccttttacaggtgacaaaaatgaggcttacaggttaggccactagattatacaagtcagtcagcgcaggggttttgattcagttcctgtctgctgcttttaggagctccagttagttgaaactggggaatgacccaattgtaccttctcttttcagcattcattttgtgctaaatattgcgcacatcattgtatgtaatctccgtaactccaagttattctcactctgcagatgagtaaactggggaacagaaacattcagcaatatggcacccagctagtaaatgtggaagccaggactcaaattctcactttgcagccagatagcttgcaaagacagttcttcagccctctccttgcccacagaaatactagggtcaggactactaaaatgtctttaatgagagccttgaatcaagtaagcaaagtaggtgatgcccctgaacgggcctagctcctgcacagtcacagtccagccataggacccttgttccaggcagggcagtcgcacatcagggtcctcatctgagaactgaatcagggtcccctgagggtttagaaccctcaagcattctgatagaagctggtaagccctaggcagacctccccgggcaacagcatcccatgtgcctttgtccagcagtagttggaaagagcctgaagaagccacagcccccaggttctgagcatcggcgtgcatgaagtggaggcttgaggcagggtgtccagggcatagaggtgtttggcctgggccaccctccaggaggctattcatgtgggccacagccacaggagaaaagtccacccccagcacatccactgggtgtggagatttggtgtagaggcctgtacataggctggaagtcccacagcccacatccagcactcgcagaggactggcagcctgtgcctcctgcagcaatggcagtaggagcccctggacttcgtcgtatccaaagaaccagtcgaaggtggggacagtgcccaaacgaggctgggcatgcagccgatcccagagacagcggtccgccaggcaactatcagccagtgagcctgtgggcacggttggagggtgtcacttggtctatgtcgccactacccgcaaaggggcggcacgtccccatcatcaggctcggcaagtggagcattcgacgcagcgcggccatctggagattcgggtaagttcgaccagagaagcttatgtgaagcgtccaccctactccagccggagaggcctgaggtccaggggaagatctgcaaattccgcgtagcgaaaggcggcgtacagcttccccgaactctgcagtcccggaaaaaagaacgcggacacagactatggtaggaacggcctttattggctgcagcgggaagtggaggagggtatacagcgtccgcagacctgaaatcaaatgagaaagtgtgagcaccccgatggaggagccagctggatctcggttgtccttctccgagattcccggtgtcccggcgtttgaggatagaaccagcggatgggaagccgccagcaccgaagacatgacgccgagggggccagagccctttccctcttcctccgtacattacggggagcggcaccacaagcccgatccccgccaagaaaaggagggtcctgagaccccgcccagagccttccacccggcacccccaccactcccggccgcccaatctggctactacagctaaaaccaccctcgtgccg

SEQ ID NO: 276629 - DNA, 1642 bp, Homo sapiens
aaaaagaaagaaaagaaaacacaggaaaaggaactcacctcttttatcatcttagtatttagtactaatggtttagagcaggaattgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcagccccttataagggcactaatcccattcatgagagctccaccctcacgacctaatcacctccaaaaggccccatttcgtaataccgtcagttaagtttcattatatgactttgatggggatatagcccatagtaggttgtatgtccctgaaagcctaaaatatttactgtttggctctttacagaaaatattttcttggcccctgttccagagcattcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcgtatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtcagaaaaaaat

SEQ ID NO: 276630 - DNA, 603 bp, Homo sapiens
agcttgccagccaccaggcgctcagcctccaccgccgacttcagcaccagctccttgacctgtgcatccagcttctgcatttcgctcacctggccgaggcaagagcagggcaggacttgtgagctgtcctcccaccccactcagcaggccccaccatctcccaggcctacagaccccagagctccacagggtcaagacctgctctgtgatgcaggctaccttcatcctggcttctgcggctggatcctgaaggaaggagaggcaccatgtgtgacaacatccaggcttgggtccactctgaccttatctcccaaagaacatctgccaccagcagccatccaaaaatgaaatgccaccttcttggaaagtcaaagtcaaacccctactgatacctaatctggaccaggttcagcaatgggcaaaactagggccataaagatgagcagaccagccgggcctggtggctcatgcctgtaatcccagcactttgggaggccaaggtgggcagatcacgaggtcaggagttcaagaccagcctgaccaatatggtgacatcccatctctactaaaaatagaaaaaaaaattagccgggcatggtggca

SEQ ID NO: 276631 - DNA, 612 bp, Homo sapiens
gcgttacttcctggagacttcaggtgtggtagccggcgccgcgcccatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctctta

SEQ ID NO: 276632 - DNA, 1564 bp, Homo sapiens
ccagacatcatcagctttagagctaccacaattttaaagatccgagttcagataatcactgctgcccctggagtcagagccaaggctccacctttcgaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttggccatccttgcagaaaagagcctaaaattgggtgatttacccacaaagtgaaagtcgagggaaaattcagtttccagtctctgaactctatgcgataatctcctatcattagggctacatgctttcttgttctgtcttttaaatattatatcaggataaaggagagggctccctcctgaaatgggtcaagaaagaagatagacttgtagctttaaaagggtggg

SEQ ID NO: 276633 - DNA, 804 bp, Homo sapiens
gcgttacttcctggagacttcaggtgtggtagccggcgccgcgcccatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttaaaaaaaaaagaaaaaaaaaaaaactttgtgggcggcctggcccggaaaagttttgaacccttgggggggggggccctggttaggaactggccagggggccgggaaacgggcggacgggcgggttccccaaaaaacgccgggcccgggtttgaacaccgagggtcgggccggtcccacacgggccggcgtaga

SEQ ID NO: 276634 - DNA, 701 bp, Homo sapiens
  misc_feature (11)..(12): n is a, c, g, or t
  misc_feature (14)..(14): n is a, c, g, or t
  misc_feature (19)..(21): n is a, c, g, or t
  misc_feature (23)..(23): n is a, c, g, or t
  misc_feature (25)..(25): n is a, c, g, or t
  misc_feature (28)..(28): n is a, c, g, or t
attcggcacanngngccgnnntncncgnggccgcgcccatagccggacggggatctgagctgatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttaccggaacttaaaacctggtaggcaacctcaggggggggcccggttcccaattcgccttataaggaagtcggtttacaaattaatggcccgttgcttaaaaag

SEQ ID NO: 276635 - DNA, 437 bp, Homo sapiens
gcgttacttcctggagacttcaggtgtggtagccggcgccgcgcccatagccggacggggatctgagctggcaggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctctta

SEQ ID NO: 276636 - DNA, 537 bp, Homo sapiens
gcgttacttcctggagacttcaggtgtggtagccggcgccgcgcccatagccggacggggatctgagctggcaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttaaaaaaaaaaaaaaaaac

SEQ ID NO: 276637 - DNA, 1493 bp, Homo sapiens
cgaggatcccgaaaccactactggctctgatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttggccatccttgcagaaaagagcctaaaattgggtgatttacccacaaagtgaaagtcgagggaaaattcagtttccagtctctgaactctatgcgataatctcctatcattagggctacatgctttcttgttctgtcttttaaatattatatcaggataaaggagagggctccctcctgaaatgggtcaagaaagaagatagacttgtagctttaaaagggtggg

SEQ ID NO: 276638 - DNA, 1447 bp, Homo sapiens
gcgttacttcctggagacttcaggtgtggtagccggcgccgcgcccatagccggacggggatctgagctggcaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttggccatccttgcagaaaagagcctaaaattgggtgatttacccacaaagtgaaagtcgagggaaaattcagtttccagtctctgaactctatgcgataatctcctatcattagggctacatgctttcttgttctgtcttttaaatattatatcaggataaaggagagggctccctcctgaaatgggtcaagaaagaagatagacttgtagctttaaaagggtggg

SEQ ID NO: 276639 - DNA, 1422 bp, Homo sapiens
cgaggatcccgaaaccactactggctctgatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcaatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttggccatccttgcagaaaagagcctaaaattgggtgatttacccacaaagtgaaagtcgagggaaaattcagtttccagtctctgaactctatgcgataatctcctatcattagggctacatgctttcttgttctgtcttttaaatattatatcaggataaaggagagggctccctcctgaaatgggtcaagaaagaagatagacttgtagctttaaaagggtggg

SEQ ID NO: 276640 - DNA, 541 bp, Homo sapiens
gcgttacttcctggagacttcaggtgtggtagccggcgccgcgcccatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcaatcaacaaatactgagggatgggttttgggacagctccatgggcatggggaaggcactgaaacagaggactataaaacatccttctctta

SEQ ID NO: 276641 - DNA, 239 bp, Homo sapiens
tactttctgcccctcacactgccaccttccctgttcccaggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctgtgagtctatgggggaaatgagatatgctgggttagaaagagctcca

SEQ ID NO: 276642 - DNA, 1539 bp, Homo sapiens
gcgttacttcctggagacttcaggtgtggtagccggcgccgcgcccatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttggccatccttgcagaaaagagcctaaaattgggtgatttacccacaaagtgaaagtcgagggaaaattcagtttccagtctctgaactctatgcgataatctcctatcattagggctacatgctttcttgttctgtcttttaaatattatatcaggataaaggagagggctccctcctgaaatgggtcaagaaagaagatagacttgtagctttaaaagggtggg

SEQ ID NO: 276643 - DNA, 638 bp, Homo sapiens
  misc_feature (11)..(12): n is a, c, g, or t
  misc_feature (14)..(14): n is a, c, g, or t
  misc_feature (19)..(21): n is a, c, g, or t
  misc_feature (23)..(23): n is a, c, g, or t
  misc_feature (25)..(25): n is a, c, g, or t
  misc_feature (28)..(28): n is a, c, g, or t
attcggcacanngngccgnnntncncgnggccgcgcccatagccggacggggatctgagctgatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttaaaaaaaaaaacacaaaagacacaaaaaaaaaaaaaaaac

SEQ ID NO: 276644 - DNA, 1633 bp, Homo sapiens
tttaaagttttccccaagtcttcagtttttattttctgcgtgatgggtaagttcttcattcccaatagagttcaggggattggggctatctgagagacaactgggagatagctcaagaggggttgagaaaaaactgagctggactcctgcctgatcccccattacggcgatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttggccatccttgcagaaaagagcctaaaattgggtgatttacccacaaagtgaaagtcgagggaaaattcagtttccagtctctgaactctatgcgataatctcctatcattagggctacatgctttcttgttctgtcttttaaatattatatcaggataaaggagagggctccctcctgaaatgggtcaagaaagaagatagacttgtagctttaaaagggtggg

SEQ ID NO: 276645 - DNA, 1526 bp, Homo sapiens
  misc_feature (11)..(12): n is a, c, g, or t
  misc_feature (14)..(14): n is a, c, g, or t
  misc_feature (19)..(21): n is a, c, g, or t
  misc_feature (23)..(23): n is a, c, g, or t
  misc_feature (25)..(25): n is a, c, g, or t
  misc_feature (28)..(28): n is a, c, g, or t
attcggcacanngngccgnnntncncgnggccgcgcccatagccggacggggatctgagctgatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttggccatccttgcagaaaagagcctaaaattgggtgatttacccacaaagtgaaagtcgagggaaaattcagtttccagtctctgaactctatgcgataatctcctatcattagggctacatgctttcttgttctgtcttttaaatattatatcaggataaaggagagggctccctcctgaaatgggtcaagaaagaagatagacttgtagctttaaaagggtggg

SEQ ID NO: 276646 - DNA, 651 bp, Homo sapiens
gcgttacttcctggagacttcaggtgtggtagccggcgccgcgcccatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttaaaaaaaaaaacacaaaagacacaaaaaaaaaaaaaaaac

SEQ ID NO: 276647 - DNA, 516 bp, Homo sapiens
ttttttttaacgtttccagttttgcattaaaaaaaaaaaatggagttggcagttggaaccgcctgagggttttcacagcaattaccctaaacagttaggtggtgtctattcgttgagaaagattccttttttcttttcaaaaggaagatagtataccactgtttaaacaccaaaaagggcttgccttcacgctgctagaggattctcccgagggccaaaagcacagtgggaattcctcaaaaggggcctacctggctgcagtcagcggcttgagcggctctgatggtggtcagagccccctggaccaagatgcatggaatgtgccctcttgaagagctagtctcatccctcccatctgtagccctaagaggcaagcctgtatctgtgcaaggtatggacccgggcaagggacatggcgcctcccccacccatccgatcctcattcctaaactaagagaggcagacaatggcccgggcttggtgagaggtctggtcactcaccttactctgctttct

SEQ ID NO: 276648 - DNA, 3843 bp, Homo sapiens
acgtgccctgccagtggggcccccgcagctctcgtcccgggcgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtaccgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttgaaaagtatgctagcagacaagcatttgagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgc

SEQ ID NO: 276649 - DNA, 382 bp, Homo sapiens
acagacttaccaaggtcaataagaatcgcatgctgctgggaagtcagctgctttaagagttctttgtatggcacaatattgtgtccgctaatgaggtggttctcaatgtcgctctcctcgaaggagctgaagaagccgctgcttcggaggcccccatcctgcagctccttcctaaaggccagcgagcgcaggccgggctgggagaaggacttgcgcatgggcctgcgcacaggctcctggctccctgtgggcgcggcatggggcgggttggggcgggggctctcggacccccggctgccgctgacgtgattgaacttctcgatgcactcgtcgatcagggccggcggagccttcttgtgcgccaccgtcacgcggccgcaga

SEQ ID NO: 276650 - DNA, 438 bp, Homo sapiens
agcaaaaggatatctccttaaaatttttctccaatgctatttttttggtgtcaggactgatgaggtaaacttcagactggccaatcgtgaagagcatagttcgattttcctcgatatctgtgggctgcacaatattgtgtccgctaatgaggtggttctcaatgtcgctctcctcgaaggagctgaagaagccgctgcttcggaggcccccatcctgcagctccttcctaaaggccagcgagcgcaggccgggctgggagaaggacttgcgcatgggcctgcgcacaggctcctggctccctgtgggcgcggcatggggcgggttggggcgggggctctcggacccccggctgccgctgacgtgattgaacttctcgatgcactcgtcgatcagggccggcggagccttcttgtgcgccaccgtcacgcggccgcaga

SEQ ID NO: 276651 - DNA, 425 bp, Homo sapiens
tcgctccataaagcagattttctcttgaaagcgtatggcagactggggctgtgcacgagctgggtgatattttaccgtgaagagcatagttcgattttcctcgatatctgtgggctgcacaatattgtgtccgctaatgaggtggttctcaatgtcgctctcctcgaaggagctgaagaagccgctgcttcggaggcccccatcctgcagctccttcctaaaggccagcgagcgcaggccgggctgggagaaggacttgcgcatgggcctgcgcacaggctcctggctccctgtgggcgcggcatggggcgggttggggcgggggctctcggacccccggctgccgctgacgtgattgaacttctcgatgcactcgtcgatcagggccggcggagccttcttgtgcgccaccgtcacgcggccgc

SEQ ID NO: 276652 - DNA, 1790 bp, Homo sapiens
tactaaccatgctgaccactgttcggaacgggattgaatcacagaaaaacagcaaatggctctctcttacagagtgtctgaacttcaaagcacaattcctgagcacattttgcagagcacctttgttcacgttatctcttctaactggtctggattacagacagaatcaataccagaggaaatgaaacagattgttgaggaacagggaaataaactgcactgggcagctcttctgatactcatggtgataatacccacaattggtggaaatacccttgttattctggctgtttcactggagaagaagctgcagtatgctactaattactttctaatgtccttggcggtggctgatttgctggttggattgtttgtgatgccaattgccctcttgacaataatgtttgaggctatgtggcccctcccacttgttctatgtcctgcctggttatttcttgacgttctcttttcaaccgcatccatcatgcatctctgtgccatttcagtggatcgttacatagccatcaaaaagccaatccaggccaatcaatataactcacgggctacagcattcatcaagattacagtggtgtggttaatttcaataggcattgccattccagtccctattaaagggatagagactgatgtggacaacccaaacaatatcacttgtgtgctgacaaaggaacgttttggcgatttcatgctctttggctcactggctgccttcttcacacctcttgcaattatgattgtcacctactttctcactatccatgctttacagaagaaggcttacttagtcaaaaacaagccacctcaacgcctaacatggttgactgtgtctacagttttccaaagggatgaaacaccttgctcgtcaccggaaaaggtggcaatgctggatggttctcgaaaggacaaggctctgcccaactcaggtgatgaaacacttatgcgaagaacatccacaattgggaaaaagtcagtgcagaccatttccaacgaacagagagcctcaaaggtcctagggattgtgtttttcctctttttgcttatgtggtgtcccttctttattacaaatataactttagttttatgtgattcctgtaaccaaactactctccaaatgctcctggagatatttgtgtggataggctatgtttcctcaggagtgaatcctttggtctacaccctcttcaataagacatttcgggatgcatttggccgatatatcacctgcaattaccgggccacaaagtcagtaaaaactctcagaaaacgctccagtaagatctacttccggaatccaatggcagagaactctaagtttttcaagaaacatggaattcgaaatgggattaaccctgccatgtaccagagtccaatgaggctccgaagttcaaccattcagtcttcatcaatcattctactagatacgcttctcctcactgaaaatgaaggtgacaaaactgaagagcaagttagttatgtatagcagaactggcagttgtcatcaaacataatgatgagtaagatgatgaatgagatgtaaatgtgccaagaatatattatataaagaattttatgtcatatatcaaatcatctctttaacctaagatgtaagtattaagaatatctaattttcctaatttggacaagattattccatgaggaaaataattttatatagctacaaatgaaaacaatccagcactctggttaaattttaaggtattcgaatgaaataaagtcaaatcaataaatttcaggctttaaaaaaaaaa

SEQ ID NO: 276653 - DNA, 450 bp, Homo sapiens
taaactgcactgggcagctcttctgatactcatggtgataatacccacaattggtggaaatacccttgttattctggctgtttcactggagaagaagctgcagtatgctactaattactttctaatgtccttggcggtggctgatttgctggttggattgtttgtgatgccaattgccctcttgacaataatgtttggtaagtatttcactttgtttgtgccatcaaaccacagaactatgatatactattagagaatggacactcatttaatctttacttttcttgaaataaaagatgaacttggactatttaaagatacggcaagtaaacagtcccttgttttatatcattctctatggttgatcagcagttttaaagagcaaaaaatattttttgtaaactatttttctccctcctaagctatctaataaaatcatttaaaaagtca

SEQ ID NO: 276654 - DNA, 416 bp, Homo sapiens
ctttcttccagatctcctctggcacgtatccagacgcaggcctgtgaaggaattcccgatgcgcgtctatgaaaaggatgggaagggggtggagagaggaggagagtactgtaagcacacttgtgtcatcgcacagagtgaaaggcacacagattatcaactggcaagaacattagattttctcaactattctgaattagcaaaaatttactacagcttggtgaggaatatatggaaactatatcatctttgcaattttttaatctaaaattattccaaatatttaaaagtttattttcaaaagtttacactgtgatgtcatgactacttaataataggatggactggaaatatctatgcattctcctgtgtatattcatttctataaagtaaatgacaaaaataaaaacgttttt

SEQ ID NO: 276655 - DNA, 413 bp, Homo sapiens
ggtggctggtgcctgtaatcccagctacttgggaggctgagataggagaattgcttgaactgaggaggcggaggttgcattacaccactgcactccagcctgggagacagagtgagactttgtccaaaaaaaaaaaaaaggaaaaaaaaaaaagaaaaagaaaaaaagaaaattataaagctttttctaaaatagttataaatttacactcccaccaaaaaatatatgagagttctgataattctgtatcctagctaacctttggtgtttaattctttttaatggtagctactctaatgttataatcctatctcattttatttttaatttttctatttttaatatttgtgagtacatagtaggtgtatgtatttatggggtacatgaaatattttgatacaggcatgcaatat

SEQ ID NO: 276656 - DNA, 458 bp, Homo sapiens
  misc_feature (114)..(114): n is a, c, g, or t
gcgcgaagaaggcggccatgagtccgttgcaggcccgccacagcgctggcgccatggctcggagaacacggcgcggggcggcccctaaggtaaaagccttgctccaagtccccnttctgacttctagtcacttccgtgctgccagcagagggcgtgggattcttcctgaggagcctgagtctcagctttgccaggtccttgctgtgtgaccttgggcacctgtgctcccttgacaaagaggaataaaacctcttcagactactctcctatcgattctctcctggaacatatgaccaccatcaattataggcaagaacatgaacacgggagtcccaaagacttgggttcaaatgtcagccccttcactcgctggctgtaggtgtgaggccctgggtaaggtccttacctccccaagtgtctgagcctgttcccgtataatgttcacttgccttgaatat

SEQ ID NO: 276657 - DNA, 838 bp, Homo sapiens
  misc_feature (1)..(1): n is a, c, g, or t
nggagttatcgctaggtacgaggctgggtgtgctccctactggccgctcgaagcttgaagctgcagttcactttcgcgaatgtaaggaacccagcttctgtgtggtgggcactgagagcagaaccgcattgagtcggagtggagcacagaagtgtaggtccttttgcgctgtttcaagctaaacccgtgtcactgatgccgtacagaagttacagaatgggacgccaccccaaacattacgtcatccgctgaccatttccttgcggtcttcccaccgtctaaatcgccatataatctgatggatggggtcctcgcgcggttcagctcctgggcgacagcgtaacccgtcgctcctccctctgcgggagggcgtggacggggcacgggatttggagcgtggaaggaatcgggaccgaaaggagtcccaggacaccggaaccaggactccccggcgcacccggagagtttccgagctcctttgaagtatgaatcagaacttctggatgggaatcctggagccaccacttgccctatggtcgcaatgggcaagtcgctcaacctcccagatcctgttttctcatgagtaaaacggggattataatacccacctgacaatattatttttgtgagaattaaatgagtttagaatgtaaacaaaacacaacacacaaaaaaactctccggggcgctctatgccgggggcggaacaagggggttcggaatggcgcctgggccatagcggtttcctggacccagttttcttgtccacggtgggactctcggccggtcgcctatagggagccgttaaattccgaaaacccgtaactctagttcgcca

SEQ ID NO: 276658 - DNA, 1166 bp, Homo sapiens
cggttcggcctccccactccctctcctccctccgcgctccaggtctgggctgcccgttttcgcactcgccattggcccttgcccccgtcgctcagccctgtgccccttccagccccgcactgggttggccctaaatactgccgctcggaactagccccgcacagtcctcttatgctcattgggcaaggggccgaggccctctgaagatacctctccccattggctgcgccggggtccgtctgccccatctacgagtctcgtaaacgattggcctccgccactgtcgcttagaaagaagccagcctgcttcccagcttgcctactggaagggggagcacccaggtgcgtctccgcccctcgctccctactggccgctcgaagcttgaagctgcagttcactttcgcgaatgtaaggaacccagcttctgtgtggtgggcactgagagcagaaccgcattgagtcggagtggagcacagaagtgtaggtccttttgcgctgtttcaagctaaacccgtgtcactgatgccgtacagaagttacagaatgggacgccaccccaaacattacgtcatccgctgaccatttccttgcggtcttcccaccgtctaaatcgccatataatctgatggatggggtcctcgcgcggttcagctcctgggcgacagcgtaacccgtcgctcctccctctgcgggagggcgtggacggggcacgggatttggagcgtggaaggaatcgggaccgaaaggagtcccaggacaccggaaccaggactccccggcgcacccggagagtttccgagctcctttgaagtatgaatcagaacttctggatgggaatcctggagccaccacttgccctatggtcgcaatgggcaagtcgctcaacctcccagatcctgttttctcatgagtaaaacggggattataatacccacctgacaatattatttttgtgagaattaaatgagtttagaatgtaaacaaaacacaacacacaaaaaaactctccggggcgctctatgccgggggcggaacaagggggttcggaatggcgcctgggccatagcggtttcctggacccagttttcttgtccacggtgggactctcggccggtcgcctatagggagccgttaaattccgaaaacccgtaactctagttcgcca

SEQ ID NO: 276659 - DNA, 900 bp, Homo sapiens
cggttcggcctccccactccctctcctccctccgcgctccaggtctgggctgcccgttttcgcactcgccattggcccttgcccccgtcgctcagccctgtgccccttccagccccgcactgggttggccctaaatactgccgctcggaactagccccgcacagtcctcttatgctcattgggcaaggggccgaggccctctgaagatacctctccccattggctgcgccggggtccgtctgccccatctacgagtctcgtaaacgattggcctccgccactgtcgcttagaaagaagccagcctgcttcccagcttgcctactggaagggggagcacccaggtgcgtctccgcccctcgctccctactggccgctcgaagcttgaagctgcagttcactttcgcgaatgtaaggaacccagcttctgtgtggtgggcactgagagcagaaccgcattgagtcggagtggagcacagaagtgagtcccaggacaccggaaccaggactccccggcgcacccggagagtttccgagctcctttgaagtatgaatcagaacttctggatgggaatcctggagccaccacttgccctatggtcgcaatgggcaagtcgctcaacctcccagatcctgttttctcatgagtaaaacggggattataatacccacctgacaatattatttttgtgagaattaaatgagtttagaatgtaaacaaaacacaacacacaaaaaaactctccggggcgctctatgccgggggcggaacaagggggttcggaatggcgcctgggccatagcggtttcctggacccagttttcttgtccacggtgggactctcggccggtcgcctatagggagccgttaaattccgaaaacccgtaactctagttcgcca

SEQ ID NO: 276660 - DNA, 416 bp, Homo sapiens
gtgacccaccgggcccggcaaagtttttaaaagtggtttcgttaccctgcccaggagtcccaggacaccggaaccaggactccccggcgcacccggagagtttccgagctcctttgaagtatgaatcagaacttctggatgggaatcctggagccaccacttgccctatggtcgcaatgggcaagtcgctcaacctcccagatcctgttttctcatgagtaaaacggggattataatacccacctgacaatattatttttgtgagaattaaatgagtttagaatgtaaacacgctttgtaaagtaattggcagttgggattagtgtgccctttctcccggagccttgcatcctgtgcatttgctcaggtgctgttccttctctgagcaactaattaaaggtccctaacccgatgta

SEQ ID NO: 276661 - DNA, 670 bp, Homo sapiens
catgtactgagctttcatatttattttgagatatataatttcaaaatatatatagtatataaacagacattcattaaaaaacaaacgaggaaaacgatgttaacataatttcagtaccctctctgaggtcagctttgaactcattcatactctgacaagctgagaatcactgtgcattctcaagcatagcacgctccacagttttaggctgcatcccccagatctgcatcacagccttcttgtagcattcttctgttggtcgatagtgagcagctaaccacagtcagaagacattggttctattgggatgagcactttattctttatttttggtctaaatgtacttaacttgagtaagtggtataaggtcctttcattagtctagatcaccagtgtatcaggagggtagtgtggggatgacagttgaggattctgaagttgactacaagggtttgaatcctggcacttattacgtgtgtagccttagatgagttatttcacctctacctcagttttcttatgtgaaacatgaaggtaatgaaaatagaaaaatgagaattgagaaatggatgtccatctgttgtacactaaatgttcagtgtccttatcagtgccatattcatcaccactagtcttttcccacccaacctctgcaggatgtgaagtgata

SEQ ID NO: 276662 - DNA, 768 bp, Homo sapiens
cgaagtctggaaagttggcagggtctctctgggctgcccaggaaggtgacccagggtcctgggaagccaggtactgccagaagaggatggctggggcccagagcacaaaggaaaccagccaggccaggccgatcatcagagctgcccggcggggtgtgcgcttggcacggtagctcaggggccgagtcacggagaagtagcggtcaaagctgatgagcagcagattcatgacggaggcattgctggccacatagtccagggccagccagaggtcacaagccagcgtgcccagagcccagtggcccatgagcaggtcctgctatccccagtttgcaaaaggcctaacctgaggcttcaagacctgaaggaccttacagctcatcagcgatgcaaccaggatttggatccaggccgtctgcctccgagaccaacctcttgaaccctactcctgcccttgaggggttgcgggggtttgccagcctccttgcccacctcagctagcttactcaagcccaactttgaatcagttaacgatgagcaatcggtccttctttcagaatctggcctcctttgtgtgcgcggcagtgtctgtcgtatatctgtgtgatgtgtgataacagtgctgtgggaagagggtgggtctactggagctctttaaagggcagggtaagggctgcgtctgtctcattcaatgctttatcccagggcttggcagatagtagttgctcaataaatacctgtggaataaatgtacgtgtgtgtactcaa

SEQ ID NO: 276663 - DNA, 5744 bp, Homo sapiens
  misc_feature (1)..(1): n is a, c, g, or t
  misc_feature (4)..(4): n is a, c, g, or t
  misc_feature (8)..(10): n is a, c, g, or t
nccngcgnnnggggaagtccaggagcatgggtggtttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacagcagcgccctcagcaagcgttccctggccgcgcgcgggtacgtgcaggacccctttgccgcgttgctggttccgggcgcggcgcgccgcgcaccgctcattcaccgaggctactacgtccgcgcacgcgccgtgaggcactgcgtgcgcgcttttttggagcagattggcgcgccccaggccgcgcttcgcgcgcagatcttgtctctcggcgctggcttcgactcgctctattttcgcttaaaaaccgcgggccgcctggcccgggctgcagtctgggaggtggattttccggacgtggcgcggcgcaaagcagaaaggattggagagacgccagagctgtgcgcgttaaccgggcctttcgagaggggggagcccgcgtccgcgctgtgctttgagagcgcagactactgcatcctgggtctggacttgcggcagctccagcgagtggaggaggccctgggcgccgcggggctcgacgcagcctcacccactctgctcctggccgaggcggtgctgacctacctcgagccggagagtgccgcggccctcatcgcctgggcagcccagcgttttcctaatgcccttttcgtggtctatgagcagatgaggcctcaagacgcctttggccagttcatgctgcaacattttcggcagctaaactcccccctgcatggcctggagcgttttcctgacgtggaggcgcagcggcgccgcttccttcaagctggctggaccgcctgcggtgccgtggacatgaatgaattctatcactgctttcttcccgcagaagaacgccggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacattagacctttcttccttaagtgctgggcagtaaggactggactaatattcaggacccactaaagtagacaataaagttttccacaaataggatgaccctctagctatagatactgccactcctcctttccccatcctttttttcccttagcactattcagtgcaaaaagtgaaaaaggttggtaaaataggtaaaatacctagaaacaatcactacagaaaacagctgaagacagtggccatgcagtccgagaggagtagtggtctgcctctaattttctaatctaagttcgtttattgagttacagtggtctttagtaaagtaaaacaatttcccaatcccaggccttgtgatttgagatggtaccttagaaaaagttacacgcagttccgtggttgaatatatttgagatggtaccttagaaaaagtttcacgcagatccttggttgaatatagttgagggagcgtagtattgacaattcttcatgtaggaaacctgaaatgaacacagtcacagtttgattaaaacattgtcctgtttgttgcaacagaaaactcggatagttttaacaacaggaaacacttgtaggacttcctttaccaacatactttttaaatgttttgctattggttccatatttatttagatttataagtgtcaataaagcaaacttttgatgcctcaattcattttgcacggggtataataatgttttgttccagatatactctccacctttcactgttctgtgctccaagaggctgacctttatgggctgcatcaaggagctctctttactttttggttgagttccaccagtcagaggcaccagaggggaatgggggcaaaaagaagagtgagagtgagttggtatttattcccaattcttcccctgttggtttgcaagttggcagtggcagcattcttctgtcaaaggctacagctcctgccgtgtaatcctttcctgaagacagagttctaattctgcatcatcccaggtttcagtaattgttcctttacttcaccttttcaggcctaggagttgtgatggctctttgctagacctgaactgtactgtccaatgtggtagctattgacaacatgtgactatttaaacgaattaataaattcagtggcttagtcacattgaccacattttaagtgcttaataactatgtgtggctttggctactgtattagacaatgtagatgtagaacatttcatcgttacagaaatttctactggacactgctgactggatatcttgacttggtttcccttaaccctactcagccccttatagttagcatcccattaaactcaattatcccttttaaatgggaatctgttgcctagtgagccatgtgagatcaatgaaatagctattcatccttaaaatttgagccttaatttgtcatctaaattatgcataccttgtgaaatatacacctcaaaaaatgtagtggctttggtggtaataagtgtattactttagtatttcttcttagtcctagaaaccttagtagttttcattctacaagtgcctaaatgattattatgaaccatcattgatgacaaattgcatcctttatttctattaattttgcatataaatggatgtgaaaggtgattaatataaaaaccaagtagcaaacacaaacctaagtgtatggagaggacagtcttggctctgttagatgaagcctccccgggggagaccagctgaatgagggttgtggtataggctgggcatggtggctcacgcctataattccagcactttgggaggccaagacagaaggatcacttaaagccaggagtttaagaccagcccaggcaacaaagtcagatccccatctctacaaaaaaataagtaggcacggtggtgtgtgcttgtagtcttggatactctggaggctgaggtgatagtgagctgtgattgtgccactgcactcctgcctggttgacagagtgagaccccgtctcttaaaaagaaaaaaaaaaaaggttgttgtccaacttcagctttcctgagactttgtaagagccatttctagggaaagcattggttatggctatgactgagtcctgggaaacagggcttattacagctgggaagacatctggcaaggcgatcagtgggccaggtagtagaaaactggcagggaatatgatcagcaggagaaaatggctgttctgtatttcctgtttctaagtttactacagcacaccccagctttcaggagcagataaaagcagaacactgtgatgaggccaggcgcagtggcacatgccttgatcccagcactttgggaggccaaggctggcagatcacttgaactcaggagttggagaccagcctggccaatatggtgaaactccgtctctacccaaaaaaaaaaaaaaaaggaagttaatgaaaaatatcatcaaacaaaagggtaaacaagtcttagtgaaaaagggcaaactattggtgcaataatataccctttaaagacatcatcatttcaaatagggctgtacaaatatagaaagatgtaggatgaattcaaaacctatgactaaataatttaaaccaaacgcaataatgatgagaaagaaagaagatccatgttcaattggggatttatagtttctttataaagatgaagtacagtgactctagtgtagtggttctcaatgggggacaatttcatcccccacatttagcaatgtctggagacattttggttgtcaatactgaggggtgctactaatgttaggagtcaggtatgccactaaatatcctccaatgcacaggacaactttaacaaagaattacttatacagtctaaactgtctatactgccatttttgacaaatcctgcttcagcctatgtctgtcattatgttgataattaactgagtaattttgaggccatacctcacagtattaaacagttggatgtgtagttgtgtgggtgtattattgaaagacagtaggcttttaaggacttgagtgactttgaggccttaccttatgaagcagtgagcagcagtgataagccagctgttactaagccatgtggctccgcgtcggtagacattgttctgtggaaggctagcttgccagggccattctccttcctcagcatccagaccctctgctattctgttgccagagggagttattgtgcattgtccacaacctgctcaaaatacagttctgcttatgcacgtatattggtatagtagaacctaccacagagaatctatcccataaaaggaactcaagaaatatttgtagaaatgaagtccatattgggccaggtgcggtggctcccgcctgtgtaatgccagcattttgggaggccaaggtgggcagatcacaaggttaggagatcgagaccatcctggtcaacatggtgaaagccagtctctactaaaaatacaaaaattagctgggtgtggtggtgtgtgcttgtaatcccagctactcaggaggctgaggcaagagaatcacttgaaccagggagtcagaggttgcagtgagccgagattacaccactgcactccagcctggcaacagagcaagactctgtctc

SEQ ID NO: 276664 - DNA, 2636 bp, Homo sapiens
cgctcattcaccgaggctactacgtccgcgcacgcgcgcgggtacgtgcaggacccctttgccgcgttgctggttccgggcgcggcgcgccgcgcaccgctcattcaccgaggctactacgtccgcgcttttttggagcagattggcgcgccccaggccgcgcttcgcgcgcagatcttgtctctcggcgctggcttcgactcgctctattttcgcttaaaaaccgcgggccgcctggcccgggctgcagtctgggaggtggattttccggacgtggcgcggcgcaaagcagaaaggattggagagacgccagagctgtgcgcgttaaccgggcctttcgagaggggggagcccgcgtccgcgctgtgctttgagagcgcagactactgcatcctgggtctggacttgcggcagctccagcgagtggaggaggccctgggcgccgcggggctcgacgcagcctcacccactctgctcctggccgaggcggtgctgacctacctcgagccggagagtgccgcggccctcatcgcctgggcagcccagcgttttcctaatgcccttttcgtggtctatgagcagatgaggcctcaagacgcctttggccagttcatgctgcaacattttcggcagctaaactcccccctgcatggcctggagcgttttcctgacgtggaggcgcagcggcgccgcttccttcaagctggctggaccgcctgcggtgccgtggacatgaatgaattctatcactgctttcttcccgcagaagaacgccggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacattagacctttcttccttaagtgctgggcagtaaggactggactaatattcaggacccactaaagtagacaataaagttttccacaaataggatgaccctctagctatagatactgccactcctcctttccccatcctttttttcccttagcactattcagtgcaaaaagtgaaaaaggttggtaaaataggtaaaatacctagaaacaatcactacagaaaacagctgaagacagtggccatgcagtccgagaggagtagtggtctgcctctaattttctaatctaagttcgtttattgagttacagtggtctttagtaaagtaaaacaatttcccaatcccaggccttgtgatttgagatggtaccttagaaaaagttacacgcagttccgtggttgaatatatttgagatggtaccttagaaaaagtttcacgcagatccttggttgaatatagttgagggagcgtagtattgacaattcttcatgtaggaaacctgaaatgaacacagtcacagtttgattaaaacattgtcctgtttgttgcaacagaaaactcggatagttttaacaacaggaaacacttgtaggacttcctttaccaacatactttttaaatgttttgctattggttccatatttatttagatttataagtgtcaataaagcaaacttttgatgcctcaa

SEQ ID NO: 276665 - DNA, 3138 bp, Homo sapiens
  misc_feature (1)..(1): n is a, c, g, or t
  misc_feature (4)..(4): n is a, c, g, or t
  misc_feature (8)..(10): n is a, c, g, or t
nccngcgnnnggggaagtccaggagcatgggtggtttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacagcagcgccctcagcaagcgttccctggccgcgcgcgggtacgtgcaggacccctttgccgcgttgctggttccgggcgcggcgcgccgcgcaccgctcattcaccgaggctactacgtccgcgcacgcgccgtgaggcactgcgtgcgcgcttttttggagcagattggcgcgccccaggccgcgcttcgcgcgcagatcttgtctctcggcgctggcttcgactcgctctattttcgcttaaaaaccgcgggccgcctggcccgggctgcagtctgggaggtggattttccggacgtggcgcggcgcaaagcagaaaggattggagagacgccagagctgtgcgcgttaaccgggcctttcgagaggggggagcccgcgtccgcgctgtgctttgagagcgcagactactgcatcctgggtctggacttgcggcagctccagcgagtggaggaggccctgggcgccgcggggctcgacgcagcctcacccactctgctcctggccgaggcggtgctgacctacctcgagccggagagtgccgcggccctcatcgcctgggcagcccagcgttttcctaatgcccttttcgtggtctatgagcagatgaggcctcaagacgcctttggccagttcatgctgcaacattttcggcagctaaactcccccctgcatggcctggagcgttttcctgacgtggaggcgcagcggcgccgcttccttcaagctggctggaccgcctgcggtgccgtggacatgaatgaattctatcactgctttcttcccgcagaagaacgccggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacattagacctttcttccttaagtgctgggcagtaaggactggactaatattcaggacccactaaagtagacaataaagttttccacaaataggatgaccctctagctatagatactgccactcctcctttccccatcctttttttcccttagcactattcagtgcaaaaagtgaaaaaggttggtaaaataggtaaaatacctagaaacaatcactacagaaaacagctgaagacagtggccatgcagtccgagaggagtagtggtctgcctctaattttctaatctaagttcgtttattgagttacagtggtctttagtaaagtaaaacaatttcccaatcccaggccttgtgatttgagatggtaccttagaaaaagttacacgcagttccgtggttgaatatatttgagatggtaccttagaaaaagtttcacgcagatccttggttgaatatagttgagggagcgtagtattgacaattcttcatgtaggaaacctgaaatgaacacagtcacagtttgattaaaacattgtcctgtttgttgcaacagaaaactcggatagttttaacaacaggaaacacttgtaggacttcctttaccaacatactttttaaatgttttgctattggttccatatttatttagatttataagtgtcaataaagcaaacttttgatgcctcaaaaaaaacaagaaaacaacacacaaacaaaaaactaacaagcggggccatacacaaaacgaagaacagacacaaacaactagtggtgagacaccgacgcgacaccaacaaggagacgtttctacaacaaaaccacctggagtgagagcgcgcgcgacccaacagagtaaacacgcaacgcaacccgcacacacggtctcaaagaaagaaagacgcggggcaagaaccggtggtgggggtccccacaaaaaaaacagccgcgggggaaacacgcgtttcaaacacaccaccgagggtcg

SEQ ID NO: 276666 - DNA, 1111 bp, Homo sapiens
cggacgcgtgggtcggacgcgtgggtcgacccacgcgtgcgggtggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacattagacctttcttccttaagtgctgggcagtaaggactggactaatattcaggacccactaaagtagacaataaagttttccacaaataggatgaccctctagctatagatactgccactcctcctttccccatcctttttttcccttagcactattcagtgcaaaaagtgaaaaaggttggtaaaataggtaaaatacctagaaacaatcactacagaaaacagctgaagacagtggccatgcagtccgagaggagtagtggtctgcctctaattttctaatctaagttcgtttattgagttacagtggtctttagtaaagtaaaacaatttcccaatcccaggccttgtgatttgagatggtaccttagaaaaagttacacgcagttccgtggttgaatatatttgagatggtaccttagaaaaagtttcacgcagatccttggttgaatatagttgagggagcgtagtattgacaattcttcatgtaggaaacctgaaatgaacacagtcacagtttgattaaaacattgtcctgtttgttgcaacagaaaactcggatagttttaacaacaggaaacacttgtaggacttcctttaccaacatactttttaaatgttttgctattggttccatatttatttagatttataagtgtcaataaagcaaacttttgatgcctcaa

SEQ ID NO: 276667 - DNA, 2136 bp, Homo sapiens
  misc_feature (1)..(1): n is a, c, g, or t
  misc_feature (4)..(4): n is a, c, g, or t
  misc_feature (8)..(10): n is a, c, g, or t
nccngcgnnnggggaagtccaggagcatgggtggtttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacagcagcgccctcagcaagcgttccctggccgcgcgcgggtacgtgcaggacccctttgccgcgttgctggttccgggcgcggcgcgccgcgcaccgctcattcaccgaggctactacgtccgcgcacgcgccgtgaggcactgcgtgcgcgcttttttggagcagattggcgcgccccaggccgcgcttcgcgcgcagatcttgtctctcggcgctggcttcgactcgctctattttcgcttaaaaaccgcgggccgcctggcccgggctgcagtctgggaggtggattttccggacgtggcgcggcgcaaagcagaaaggattggagagacgccagagctgtgcgcgttaaccgggcctttcgagaggggggagcccgcgtccgcgctgtgctttgagagcgcagactactgcatcctgggtctggacttgcggcagctccagcgagtggaggaggccctgggcgccgcggggctcgacgcagcctcacccactctgctcctggccgaggcggtgctgacctacctcgagccggagagtgccgcggccctcatcgcctgggcagcccagcgttttcctaatgcccttttcgtggtctatgagcagatgaggcctcaagacgcctttggccagttcatgctgcaacattttcggcagctaaactcccccctgcatggcctggagcgttttcctgacgtggaggcgcagcggcgccgcttccttcaagctggctggaccgcctgcggtgccgtggacatgaatgaattctatcactgctttcttcccgcagaagaacgccggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttctgccgctaaagatcaacaatgcttctgagttgagggtcggtagtcctggggatggagtgtgcattca

SEQ ID NO: 276668 - DNA, 2232 bp, Homo sapiens
gcgcggtgacctagaggatcccactagtccacggtggctttaaaatgagccttaatttgtcatctaaattatgcataccttgtgaaatatacacctcaaaaaatgtagtggctttggtggtaataagtgtattactttagtatttcttcttagtcctagaaaccttagtagttttcattctacaagtgcctaaatgattattatgaaccatcattgatgacaaattgcatcctttatttctattaattttgcatataaatggatgtgaaaggtgattaatataaaaaccaagtagcaaacacaaacctaagtgtatggagaggacagtcttggctctgttagatgaagcctccccgggggagaccagctgaatgagggttgtggtataggctgggcatggtggctcacgcctataattccagcactttgggaggccaagacagaaggatcacttaaagccaggagtttaagaccagcccaggcaacaaagtcagatccccatctctacaaaaaaataagtaggcacggtggtgtgtgcttgtagtcttggatactctggaggctgaggtgatagtgagctgtgattgtgccactgcactcctgcctggttgacagagtgagaccccgtctcttaaaaagaaaaaaaaaaaaggttgttgtccaacttcagctttcctgagactttgtaagagccatttctagggaaagcattggttatggctatgactgagtcctgggaaacagggcttattacagctgggaagacatctggcaaggcgatcagtgggccaggtagtagaaaactggcagggaatatgatcagcaggagaaaatggctgttctgtatttcctgtttctaagtttactacagcacaccccagctttcaggagcagataaaagcagaacactgtgatgaggccaggcgcagtggcacatgccttgatcccagcactttgggaggccaaggctggcagatcacttgaactcaggagttggagaccagcctggccaatatggtgaaactccgtctctacccaaaaaaaaaaaaaaaaggaagttaatgaaaaatatcatcaaacaaaagggtaaacaagtcttagtgaaaaagggcaaactattggtgcaataatataccctttaaagacatcatcatttcaaatagggctgtacaaatatagaaagatgtaggatgaattcaaaacctatgactaaataatttaaaccaaacgcaataatgatgagaaagaaagaagatccatgttcaattggggatttatagtttctttataaagatgaagtacagtgactctagtgtagtggttctcaatgggggacaatttcatcccccacatttagcaatgtctggagacattttggttgtcaatactgaggggtgctactaatgttaggagtcaggtatgccactaaatatcctccaatgcacaggacaactttaacaaagaattacttatacagtctaaactgtctatactgccatttttgacaaatcctgcttcagcctatgtctgtcattatgttgataattaactgagtaattttgaggccatacctcacagtattaaacagttggatgtgtagttgtgtgggtgtattattgaaagacagtaggcttttaaggacttgagtgactttgaggccttaccttatgaagcagtgagcagcagtgataagccagctgttactaagccatgtggctccgcgtcggtagacattgttctgtggaaggctagcttgccagggccattctccttcctcagcatccagaccctctgctattctgttgccagagggagttattgtgcattgtccacaacctgctcaaaatacagttctgcttatgcacgtatattggtatagtagaacctaccacagagaatctatcccataaaaggaactcaagaaatatttgtagaaatgaagtccatattgggccaggtgcggtggctcccgcctgtgtaatgccagcattttgggaggccaaggtgggcagatcacaaggttaggagatcgagaccatcctggtcaacatggtgaaagccagtctctactaaaaatacaaaaattagctgggtgtggtggtgtgtgcttgtaatcccagctactcaggaggctgaggcaagagaatcacttgaaccagggagtcagaggttgcagtgagccgagattacaccactgcactccagcctggcaacagagcaagactctgtctc

SEQ ID NO: 276669 - DNA, 2841 bp, Homo sapiens
  misc_feature (1)..(1): n is a, c, g, or t
  misc_feature (4)..(4): n is a, c, g, or t
  misc_feature (8)..(10): n is a, c, g, or t
nccngcgnnnggggaagtccaggagcatgggtggtttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacagcagcgccctcagcaagcgttccctggccgcgcgcgggtacgtgcaggacccctttgccgcgttgctggttccgggcgcggcgcgccgcgcaccgctcattcaccgaggctactacgtccgcgcacgcgccgtgaggcactgcgtgcgcgcttttttggagcagattggcgcgccccaggccgcgcttcgcgcgcagatcttgtctctcggcgctggcttcgactcgctctattttcgcttaaaaaccgcgggccgcctggcccgggctgcagtctgggaggtggattttccggacgtggcgcggcgcaaagcagaaaggattggagagacgccagagctgtgcgcgttaaccgggcctttcgagaggggggagcccgcgtccgcgctgtgctttgagagcgcagactactgcatcctgggtctggacttgcggcagctccagcgagtggaggaggccctgggcgccgcggggctcgacgcagcctcacccactctgctcctggccgaggcggtgctgacctacctcgagccggagagtgccgcggccctcatcgcctgggcagcccagcgttttcctaatgcccttttcgtggtctatgagcagatgaggcctcaagacgcctttggccagttcatgctgcaacattttcggcagctaaactcccccctgcatggcctggagcgttttcctgacgtggaggcgcagcggcgccgcttccttcaagctggctggaccgcctgcggtgccgtggacatgaatgaattctatcactgctttcttcccgcagaagaacgccggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacattagacctttcttccttaagtgctgggcagtaaggactggactaatattcaggacccactaaagtagacaataaagttttccacaaataggatgaccctctagctatagatactgccactcctcctttccccatcctttttttcccttagcactattcagtgcaaaaagtgaaaaaggttggtaaaataggtaaaatacctagaaacaatcactacagaaaacagctgaagacagtggccatgcagtccgagaggagtagtggtctgcctctaattttctaatctaagttcgtttattgagttacagtggtctttagtaaagtaaaacaatttcccaatcccaggccttgtgatttgagatggtaccttagaaaaagttacacgcagttccgtggttgaatatatttgagatggtaccttagaaaaagtttcacgcagatccttggttgaatatagttgagggagcgtagtattgacaattcttcatgtaggaaacctgaaatgaacacagtcacagtttgattaaaacattgtcctgtttgttgcaacagaaaactcggatagttttaacaacaggaaacacttgtaggacttcctttaccaacatactttttaaatgttttgctattggttccatatttatttagatttataagtgtcaataaagcaaacttttgatgcctcaa

SEQ ID NO: 276670 - DNA, 1773 bp, Homo sapiens
ggctggtacaggcccggagtgtatgggatcatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacattagacctttcttccttaagtgctgggcagtaaggactggactaatattcaggacccactaaagtagacaataaagttttccacaaataggatgaccctctagctatagatactgccactcctcctttccccatcctttttttcccttagcactattcagtgcaaaaagtgaaaaaggttggtaaaataggtaaaatacctagaaacaatcactacagaaaacagctgaagacagtggccatgcagtccgagaggagtagtggtctgcctctaattttctaatctaagttcgtttattgagttacagtggtctttagtaaagtaaaacaatttcccaatcccaggccttgtgatttgagatggtaccttagaaaaagttacacgcagttccgtggttgaatatatttgagatggtaccttagaaaaagtttcacgcagatccttggttgaatatagttgagggagcgtagtattgacaattcttcatgtaggaaacctgaaatgaacacagtcacagtttgattaaaacattgtcctgtttgttgcaacagaaaactcggatagttttaacaacaggaaacacttgtaggacttcctttaccaacatactttttaaatgttttgctattggttccatatttatttagatttataagtgtcaataaagcaaacttttgatgcctcaa

SEQ ID NO: 276671 - DNA, 2182 bp, Homo sapiens
  misc_feature (1)..(1): n is a, c, g, or t
  misc_feature (4)..(4): n is a, c, g, or t
  misc_feature (8)..(10): n is a, c, g, or t
nccngcgnnnggggaagtccaggagcatgggtggtttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacagcagcgccctcagcaagcgttccctggccgcgcgcgggtacgtgcaggacccctttgccgcgttgctggttccgggcgcggcgcgccgcgcaccgctcattcaccgaggctactacgtccgcgcacgcgccgtgaggcactgcgtgcgcgcttttttggagcagattggcgcgccccaggccgcgcttcgcgcgcagatcttgtctctcggcgctggcttcgactcgctctattttcgcttaaaaaccgcgggccgcctggcccgggctgcagtctgggaggtggattttccggacgtggcgcggcgcaaagcagaaaggattggagagacgccagagctgtgcgcgttaaccgggcctttcgagaggggggagcccgcgtccgcgctgtgctttgagagcgcagactactgcatcctgggtctggacttgcggcagctccagcgagtggaggaggccctgggcgccgcggggctcgacgcagcctcacccactctgctcctggccgaggcggtgctgacctacctcgagccggagagtgccgcggccctcatcgcctgggcagcccagcgttttcctaatgcccttttcgtggtctatgagcagatgaggcctcaagacgcctttggccagttcatgctgcaacattttcggcagctaaactcccccctgcatggcctggagcgttttcctgacgtggaggcgcagcggcgccgcttccttcaagctggctggaccgcctgcggtgccgtggacatgaatgaattctatcactgctttcttcccgcagaagaacgccggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacagctacctttccggaccggctcgattgc

SEQ ID NO: 276672 - DNA, 3087 bp, Homo sapiens
ctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttcaaaaaaaaaatggtttcttttaaaatttcaaatatactaatgttgccacttaatactatcctaaattgttagacgtgtcctacgaaagaagtccttgtggtaccatagctcccagggtcaaggagatgataaccagttacctggcatgcatagtggacacagcctgggcgcaccctgcaaagctggcttcttctcatactcaggtgtcagtttacatctgagcctgaacaccctacctaatagtgacaattaaaggaacagcaatgggcacttgcattgcaacatatctcaagacatctgactgtgaaacgacagcatgtccaggaagaggtttccatccctgtgcttcctgaacatttgagcctactaagataaaaggtggggcactggtcttcttggtgtcgcccatcacataagttggaaaagtgacttttggtggatgctgctgaaactgtggatccttaggattaggtaaatagagggttgcttggggaaaaggcccaggtgcaggtggcggtgatgggtgaccttgttgattcttatcagttagacaataaagggtccacatgtta

SEQ ID NO: 276673 - DNA, 1556 bp, Homo sapiens
gacccaggctagagggtaaacccgttagacaaatacattgtttcgagccaacctattagaagaccctgcttctgtcaagtagcttgctagatcctggtgggaaatccatatgccttttgcatggtatcattaccccttttggaatattattccacagacctgttccctacctaagcagaaatacagcatcacttcagcatctctttagaactatccctcactcacagaatgagttgctgcaatagaataatactgcaaactagtgaagaaacagcctgtgattttccatagtttcccctgtaagtcttgtcctttttcttttaacaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttc

SEQ ID NO: 276674 - DNA, 773 bp, Homo sapiens
cgagcggccgcccgggcaggtacgcgggatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttc

SEQ ID NO: 276675 - DNA, 566 bp, Homo sapiens
cgagcggccgcccgggcaggtacgcggggaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttc

SEQ ID NO: 276676 - DNA, 654 bp, Homo sapiens
ctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagagtgagccgttggagtttagagcgtcagtgcccgcgaagcagggtcaggccagtcagccgcggccaagtcagtggcagtttcagtagctgaagcagttaaacgatgacttcatctttcgaccggggttattctacagtcaacagacgttattatgagcgagcagagcacagtacgcaagccatgtgcatccacagcaagctatgaa

SEQ ID NO: 276677 - DNA, 485 bp, Homo sapiens
gatcctgtctctacaaaaaaacttctttttaattaggcaggcgtagtggcgcatgcctgtgtacccagttactctggaggctgaggtgggaggaacccttgagcccaggaggttgaggctacagtgagccatgattatacctctgtactccagcctgagtaacagagtgagactctgtgagtcgtacacacctttatagtaatattcaattgcagcaaaacagtctatggcgatgccaccctgaacacgcctgatctcatctgctcttggaagctaagcagggtcaggcctggttagtactcggatgggagaccgcctgggaataccaggtgctgtcggctttaaaaaaacaaacactggtttgttaactaaacatcagtttttcttgacagcaaaaagaagctctgtgccctctatgggaagtggactgaatgtttatacagtgttgaccctgccacgtttgacgcttacaaaaaaaatgataa

SEQ ID NO: 276678 - DNA, 547 bp, Homo sapiens
gtaggtgtgccataaatccaacaacagggtcagatgtgccataacgtgaaagcatagtggatctctgaggtggtccaaacagctggatcccaaggactgggaggactgagttcagatcagagcaatgctgaagacagaggagcagttgattgctacagaatctttcaggggccaaagtaggtataggtgaacaggtgcaaccctagattagccctgcttagccctgtctgtgatgacacacatttttaaagggtctttctgtgcctgcagctctcatgtgaatgaaagcagttcttccctcctgctgacaatggcattagaatgaactttatgtttttcttttcttttttcagaacaagtttgccttctcctatgttttccagaaatgacttcagtatctggagcatcctcagaaaatgtattggaatggtaaattaatggttttgtcatatgatattaagcagatatgtttaatcgcatattctttagaaaggaacctaaaagtttgcattaaagtggtgcacgacaacgtttatgggaacgtacg

SEQ ID NO: 276679 - DNA, 319 bp, Homo sapiens
  misc_feature (16)..(16): n is a, c, g, or t
cattttatataatctnccccatttccccccagccagtctcactgtggcctacttcgctgtctctggaacccccgtgttcttttctgccctaggacacagcctgggcgcaccctgcaaagctggcttcttctcatactcaggtgtcagtttacatctgagcctgaacaccctacctaatagtgacaattaaaggtaggcctgtgtcagcaccctgttttctccataatactttacatgttgtaatacacttttttgtctgtctccccaactaagatgtaggtcccatgtttttgctcacgctactgtccacacatagggg

SEQ ID NO: 276680 - DNA, 2515 bp, Homo sapiens
ctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttc

SEQ ID NO: 276681 - DNA, 1857 bp, Homo sapiens
tctgagcaagctgggaacgtcttggagtccagatgaagctggaatgagccactctggatcagatctccgaagcgcccaaggagatccttgcccaccaaggctctctcaatgtcatgtaagtcaggaagagaagccactgggatgtcctcaagccgtgatttccatgtaacattcgctcctaaacgctccctggtcagacaacccacctgcacagaggagttgttgcagacaggaatggaaacagcaagtgcgaagaactctagaacaatacaaaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttc

SEQ ID NO: 276682 - DNA, 2416 bp, Homo sapiens
cacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcgttaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgttacccattctaagaaaacttttcattctgcagttccttcaacaaatatttttgagcaactcctaagggccagccattgtaggtgatgggcattagcagtggtcaagagagactgtaatttggatgtattgttttcagacctaaacacaggttaacaaagatgaaaatacaaccaaataaactggcacagtataaacacatttgtttgtttaaggaggtctcaagagggtggggaaggaggatattattagaattaatcaacctatcgactgagtagaagtgatattgcctgttaaactccctccccatcccagaaggcacagtctgagaataaatgaattaaaaaaataagttttccaataaatttaatcaataaaatatatactgaaatatc

SEQ ID NO: 276683 - DNA, 1946 bp, Homo sapiens
cacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcgttaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgtta

SEQ ID NO: 276684 - DNA, 2385 bp, Homo sapiens
cacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcgttaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgttaaacaaaaaaaaaaaaaaaaaaaaaaaaaaaaaaaaaaaaaaaaaagggggggagccgaccctagaagagtatattcccgcagggggggggcccacagccttcacgcgggatcccacagggttttcggtggaacacaaggggggggccccccctatagggcagagccgcgcattgtcatataagagggcgcaagggccccgggggcgcggcagcgtttaacaccacacgtcgctcgagcagggtggaaaacaccgcctgtgtcaccgcgggcgggacccccttgcgggagaaacgggagaccccttaaacgccggggggggcggcgggcggacacccatagtgggggcacaaagacagtcc

SEQ ID NO: 276685 - DNA, 2028 bp, Homo sapiens
cacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctaccgtgtcatcgtcttccgtgttcttaccatggggtccgggtacatacacaggcatccaaaggggatggtcaccagtccgtcggggttgagctcaatgagaagggttataggagacagcagcactggccagggatgtagcgcgttggggcaagaagccatttgccagtatccaccgcgtttgtagtacagattgtatta

SEQ ID NO: 276686 - DNA, 1619 bp, Homo sapiens
cacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacagacctgcacatcatctggcactggataatcacagaggagcatcccatcagaatgattcctgctttacctcacctgaaacgcaagtcagacacaaaaatgaggggacagcaagccctcaaaaaaaacttagtgtgcggtgagagaaaatttagcaagaagataaaataaacagactaaactcctt

SEQ ID NO: 276687 - DNA, 350 bp, Homo sapiens
ctttcctctcccttctctggtccataggtgtttgaggaactgtggaagagggaaggcaagactccagggcagattgtttcagaaaagcagcttgaactgatgcaggaccagggggcactggagcagctctgccactctgtgatggaggcccatcctcaagtggtgactatctcgggcaggggagagggccagagccagccccaggacatgcccaagagcctcgccatcgctccctgtggcagcccagaggctcttcctaagaatggctgacccagtttcatcaataattccctcactgtcatctttttagttaaggtcagaagagatgaaataggtggatattggaaaaa

SEQ ID NO: 276688 - DNA, 2025 bp, Homo sapiens
cacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcgttaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgtta

SEQ ID NO: 276689 - DNA, 633 bp, Homo sapiens
cacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccgagtgaagacagcccaagttgaattttcccattctgtatcctatcctcagaacatgctgacctggacttccatctgtcacaagcagcttgactaagatcctaggaaattcctttttttcttggcattcttctaactgacactctctgtttactgggccctctgtgcatctgtaacgtgtgatgactgatgcttataattctgaccttgaagtacttcatggcttctaaatcatcaaaaaaagattaaagcatattctcagtatcactgtaatgtttgtgtg

SEQ ID NO: 276690 - DNA, 1890 bp, Homo sapiens
cacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcgttaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgtta

SEQ ID NO: 276691 - DNA, 1455 bp, Homo sapiens
ttcagtaaggcagggttttcctgaaacttaggcctaatttttctgttggtgaaattggagagctgcagtgaggctgactctgcccctctttggtaggagtgggccttctggaggtggtcctggagcccgacatgtcctgtggagaagaggcggcaacagctgtcagggagctgcagctgatccttcaagccctggggaccagccaggcgaacatggcagagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcgttaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgtta

SEQ ID NO: 276692 - DNA, 1703 bp, Homo sapiens
cacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggttctcaacaggaggtgtgtagaagcggcggtgatgacaggcctggctctgaactgccacataaacaagaagtccttgtttgacaggaagcactacttctatgcagacctccctagggccagttgagagtggatgccaatatatccgtgcatcaccctggggagcctttgggcgttcgaacggaagtgaagaatctcaacagcatcaggttcctggccaaagccatagactatgaaattcagaggcaaatcaatgaacttgagaatggaggtgaaattctgaacgaaacacgctcatttcatcacaagctggggtgcaccatgtcaatgagagacaaagaaggaaaacaggactacaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctgaacgaagtcggcctactggagttcttccaaaatgtgataaaagaaactagggcagagccaaaaaaggtgactagttgggtcctcaacacttttctgggctatttaaagcaacagaacctcgctgtcagtgagagtcctgtcacaccctctgcactcgctgagcttcttgacctgctggacagcagaacaatttcttcatcagcagctaaacaggtgtttgaggaactgtggaagagggaaggcaagactccagggcagattgtttcagaaaagcagcttgaactgatgcaggaccagggggcactggagcagctctgccactctgtgatggaggcccatcctcaagtggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcgttaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgtta

SEQ ID NO: 276693 - DNA, 933 bp, Homo sapiens
atgatgctgagtccggaccaagcagcagattcggaccatcccagctcggcgcactcggatccggagtccctgggcggcacggacaccaaggtgctcggcagcgtgtcggacctggagccggtggaggaggccgagggcgacggcaagggcggcagccgagccgcgctctacccgcacccgcagcagctgagccgcgaggagaagcgccgccgccggcgcgccacggccaagtaccgctcggcccacgccacccgcgagcgcatccgcgtggaagccttcaacttggccttcgccgagctccgcaaattgctgcccacgctgcccccggacaagaagctctccaagatcgagatcctgcgcctggccatctgctacatctcctatctcaaccacgtcctggacgtgtagggcggggtgcgccgcggggggccgcctgtcccggcgtccgcgaaacgctacggatccggacgggcgccgtcgctcgggtggcggaggctgcggtggcccagcgagacggccgcctcgagagacggccggggaagaagctcgctacctgttctctctggtcagcagggcgacgagggaaggtttccgacgcaggcaggtggggttgtctggcgagcccgggggctcgcaggggggattttccaggccaggagaacctcgtggagacacccgagatgagccacttctggggctccccaagggttgtggttttaacccactggagactttgagttctcctacattcatccgccacaaatcttaatgtgttgaaagaatgagggcagaagttcagagtatgcaggctcataactttaggctatctggaatttttctaatggacaaatcaccaaacactgggaaggaggagagaggagggatctctcccatagagatggaaggcacagaaaggtgcgactggaaactttc

SEQ ID NO: 276694 - DNA, 459 bp, Homo sapiens
agtcccagggtgaagggaggcagcttcagtcctggggccaatagcacatccgaggaaatcagggcccctggaacacagcctgcgggactgggggcacatctgctgcccaatccagagcttgaatgctcctggtgagaaaggataacaaacagcacttccccatggcagatgcttcacagtccaagactcggggccttgaatgatccaggaaggccactgagatttccactttatctactgtttcttgtgcacgtacttaaccataaatcaaaacagcctctgtgttatcatccttcaatgttcaacacatcgcatcggagtcgccctttccctacagaatataagctctgggtctgggggctaatagtgtggggatccaccatcttgtcttgcccccacctgagacacagatgtggcttctattcgtatgtccctattaaatgcttttctctgagaaac

SEQ ID NO: 276695 - DNA, 290 bp, Homo sapiens
ccgcctcagcctttggagtagctgggactacagatccaggaaggccactgagatttccactttatctactgtttcttgtgcacgtacttaaccataaatcaaaacagcctctgtgttatcatccttcaatgttcaacacatcgcatcggagtcgccctttccctacagaatataagctctgggtctgggggctaatagtgtggggatccaccatcttgtcttgcccccacctgagacacagatgtggcttctattcgtatgtccctattaaatgcttttctctgagaaac

SEQ ID NO: 276696 - DNA, 481 bp, Homo sapiens
cacgaggggacacttccattttaagagtgtgagcagcttcctgggacacagcactcacttcctacattccttgtccaggaagttgtttctagtgctcttcaattccatgtctccaagaggcaatcccacctcaaaaggggttaaaagcaaaaacattcacaaccaaagacactgcagggaaagagttagaccttgtggagaactaatgtgcaatcttcgctttccttgaaccgagtcgacatcacggcgttgtctttggcacgtacagtctttgaataatagttgacgatcttgccgtccagtttatactgatggggaatgctctcgtagggcttgaggtcaaggtccagcacagacacggaaaaggcaaacctggacctcgatgaagggacgacaggcctttgatcagagctgcaagtaaaaagtaccatttcaggatacacaagccccccattcatttccctccctcccgttctctctc

SEQ ID NO: 276697 - DNA, 440 bp, Homo sapiens
gaagatttatggacaggaaaaagaaaatgatgtatgaacatgaaagtgaggtacacaaacagccagactggttatagctcagcattggcattatttgaacgagatctgaacagatggcctcctttgataggccgaaagtcagtgattggtggaagacacgcagttaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276698 - DNA, 209 bp, Homo sapiens
tggctgatgctgcaggcttaggcgggcagatccttgggaaggggccaagagggtggggtgcaccaggctctctttttttcccagctcccctctccgaggagctgtgcccatgagcaccaagcccattcctgtctcagctggtgccggtccccgctctcctggaccatccagcaggtacctatacaagtcgtcgaccctcagcctggtcc

SEQ ID NO: 276699 - DNA, 975 bp, Homo sapiens
agagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276700 - DNA, 788 bp, Homo sapiens
ataggctagtacgagcctggtggttaatcggcgaggcgctccggcgcgaaggtggctggtgcgtactggccgaacctaagagccgagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276701 - DNA, 1087 bp, Homo sapiens
agagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcagtgagtttgggggcagggagggactcccaacaagatctctgtcacctctggtccccaacaggctgcctcctgtgtcagtatcccagcctgcctctctgccatctctccccagggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276702 - DNA, 918 bp, Homo sapiens
agagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276703 - DNA, 706 bp, Homo sapiens
agagcggttcctctccgtggcgccctaccgccttcggcgcgaaggtggctggtgcgtaccgtcccgaaccctaggagccgagatcccacccgcaggaccccaaaacccaatgatcctgcagcagcccttgcagcgaggcccccagggaggggcccagcgcctcccgcgggccgccttgggggtgacttggggcctggacgccagggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276704 - DNA, 1209 bp, Homo sapiens
agagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggtaggttcctccactggccaggccttctgcagaatcacaggcggtcctcacagctgacctcaggccctgcctcatcgtgccatttttagctctagctgacctctgggttgtttcccatcttggctctttggaaagtgctgggaacccaggagcccctggggacctggacctggtgggaggtgctcagctaggccagcctcagctccatgccctgacagtcatttcctcttctaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276705 - DNA, 860 bp, Homo sapiens
agagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggaggcatcccacccccaagaagaactgaataaagattgctgagcaaaaaa

SEQ ID NO: 276706 - DNA, 801 bp, Homo sapiens
agagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcagccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276707 - DNA, 753 bp, Homo sapiens
agagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276708 - DNA, 896 bp, Homo sapiens
agagcggttcctctccgtggcgccctaccgccttcggcgcgaaggtggctgcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276709 - DNA, 763 bp, Homo sapiens
agagcggttcctctccgtggcgccctaccgccttcggcgcgaaggtggctggtgcgtaccgtcccgaaccctaggagccgagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276710 - DNA, 1200 bp, Homo sapiens
agagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaaacacaccagtactagtcagtgtgcctgcctccttctgttcgagtttcccctgttaaggaacttccaactcactgcctagcgccaaatcaccgctcttgcggcctcctgccctctccggccggctcacttcaacaatagcccttcgaaaccccggtgtctaacacactttatcttctctctcaaaggcccgcctggcaacctccctgctctcgctcagctctcccc

SEQ ID NO: 276711 - DNA, 898 bp, Homo sapiens
agagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccagctcccctctccgaggagctgtgcccatgagcaccaagcggcgcctggaggaggagcaggagcctctgcgcaagcagtttctgtctgaggagaacatggccacccacttctctcaactcagcctgcacaatgaccacccctactgcagcccccccatgaccttctccccagccctgcccccactcaggagcccttgctctgagctgcttctctggcgctatcctggcagcctcatccctgaggccctccgtctgctgaggctgggggacacccccagtccccccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaaaa

SEQ ID NO: 276712 - DNA, 522 bp, Homo sapiens
tttttttttttgcgtggtttagattggacgactgattattggacagaatggcatcttgtcaacacctgcggtctcctgcattatcaggaagatcaaggcagctggtggaatcattctaacagccagccactgccctggaggaccagggggagagtttggagtgaagtttaatgttgccaatggaggtatgtggttcagtatatgccttaataatcacgatttctttcctcttatattattatagtctcacagtgaccctttgatgatagacaagcaaggtgcagaggacctagctcagaaaaatttagtgaggtgcccaaagtgatccaacaaagaagtggcatgatgggctcatgaacccatttgggtgggtctcttggtcccctgtactcttcagcataaactattgaatagttgatgcttatctgatatggaaggactctgaattttaacattaaaacataccctgaaggtcattgtctaaatgacaatgaccctcattttacacatgaacaaatcaaa

SEQ ID NO: 276713 - DNA, 1364 bp, Homo sapiens
ctgttcgctgatggcaaaaggtttcagccccctcccaaatccctccccgtccttcttctaaagagaaactggtgcgtgtaggctgcgcactcccaaggagatagggagacgggccgggcgccggagaggaacccggactctgcccaaagtctcgccgcccgccggctgttttctggcagagggtgtgtcccggagggcggcgagcgcgggtgaaggctggggccaggcgcgggtggaggcgtcaccggggtcgggctagcaggccctggaatcaggcttttgggacatcccgaaagtgagtccaacttggggagaaactgagggcacctcgggcggtctggcagccgagaaggtgggcgggagaaaactttacaggaaggcagaagcaatctctgccgagggagtcagcgagcggccgcgcggagaggaggggcgggcggtccccaggcgggcgggtgcagggcgcagggcgccgacctgctggagagggggccccgggcgcgaggcggagtcccggcgcgcagccaggctggtgggggcccccggcaggctgcagattccctccggctccgggagccgcagcaggaccggccaggaggcgccatagaggggagccccatcccggtgctgacagtgcccaccgcaccctacgaggaccagcggccgtccggcggcgggggtctgcggcgacccaccggcctcttcgagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacgggattggacgactgattattggacagaatggcatcttgtcaacacctgcggtctcctgcattatcaggaagatcaaggcagctggtggaatcattctaacagccagccactgccctggaggaccagggggagagtttggagtgaagtttaatgttgccaatggaggtatgtggttcagtatatgccttaataatcacgatttctttcctcttatattattatagtctcacagtgaccctttgatgatagacaagcaaggtgcagaggacctagctcagaaaaatttagtgaggtgcccaaagtgatccaacaaagaagtggcatgatgggctcatgaacccatttgggtgggtctcttggtcccctgtactcttcagcataaactattgaatagttgatgcttatctgatatggaaggactctgaattttaacattaaaacataccctgaaggtcattgtctaaatgacaatgaccctcattttacacatgaacaaatcaaa

SEQ ID NO: 276714 - DNA, 1104 bp, Homo sapiens
atctctgtctctgggagacttccaactgggaatctcccgctgaggccacacctctagattaggttagtggcccctgatccacgccgctccagcattctgccatgagaaacctcactctgctgcagctttatcttctaaatgacgtgctgagaacacccacgaaactgcaataccggctaatcagccccagcttcttcagaaaggcttctgcttgtgactccatgatctgtagcttatacacttcactctccttccagttttcaagtacggatacctgccagtagatcagaagacatatgagtattttacaaatgacagcctgaaactattttaaaggttaaaacttaaacattcaaaccactttcccatttctccttaaatgaagcatgacagaatcatcagaacttgattgtatcataggtgaacatgaattagactttgagatttgaaaacagaacaaaatgacatcacaaatgcataccttccatgatcctttttgcagatatgaataactgtacatggctttctgcttaagctatatataagcacagagccaggttaactgcatgtgtacacgagtgtgcattacctatggtcctgcagcagaataacccttaataaaggctgcatcctctgcaagtttagaaaagcctcagagaagctgttctcggcaagggcatcaaaagcttcggggtatgcttttaagattttagactctctgtggcttccccacaaaccaactggccatttttgtgagaatcactgcaggaaatgtaaaatggcctcatggtccaaatgatccattaaatagccttttaatccaggtgtcagtaaacttgacagggcccaccaggcaaacctgcttaccaaacggtggtgtgaattaaacaagctcaggaatacggatgctggtgtaggacccaaaaagtattcatactttggctctttttcctttcctgtccttagaagcaggtgcatagtcaattcttaattgaaaagcctaatgtttgcagactgtataaactaagtcttttcttactttaccagaataatcacagacacatatgccaataaatatcatttgtttctcagctacagaaacat

SEQ ID NO: 276715 - DNA, 980 bp, Homo sapiens
cccgccgtaccagttgcgcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttcagcaaaaaaaaaaaaagggggggttaaaaatctcggggccaagttacggccgtttgcaaggcgtagagggtataaaagggggggtaaggtggaagtggctggggcctcggggatgaccagacgaaaattggcgccgtgtaaaaaagt

SEQ ID NO: 276716 - DNA, 1012 bp, Homo sapiens
gatgacacacactgagtgtgcagacgaggaatgaggggcgtgctcctggccatgtattcgctcctgcagcggcctcctgccacgatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttcagcaaaaaaaaaaaaagggggggttaaaaatctcggggccaagttacggccgtttgcaaggcgtagagggtataaaagggggggtaaggtggaagtggctggggcctcggggatgaccagacgaaaattggcgccgtgtaaaaaagt

SEQ ID NO: 276717 - DNA, 1179 bp, Homo sapiens
ggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttcagcaaaaaaaaaaaaagggggggttaaaaatctcggggccaagttacggccgtttgcaaggcgtagagggtataaaagggggggtaaggtggaagtggctggggcctcggggatgaccagacgaaaattggcgccgtgtaaaaaagt

SEQ ID NO: 276718 - DNA, 1098 bp, Homo sapiens
ggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggttgtgaccgagattcccgacgagagagactgaggggaagagaggaaggaggggcgggctcctggcaaggcattcgctcctgagcggaatcctgcaaagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctgaacacaccacagccatcagcactggaatgcaaagaccagaacaaacagaaggaagccagcagccaagccggggcagtttcagtctccaccccaaatgcaggactgtagaagcggccaggaagaaaaccaccccctcttaaggttgtttttgtgaccgttctttggagcattgttctaaaaatgggaaattacatattgctgtgccaagggcaacaaacactgctgcataagccctgcttggtgcatttctttacttgcaaggggacagagtgtgggcttaggtttgggactagagggggctttggcaactatggtgctcaggtgattatccttcgctcgtttatccaataaacatttcagcaaaaaaaaaaaaagggggggttaaaaatctcggggccaagttacggccgtttgcaaggcgtagagggtataaaagggggggtaaggtggaagtggctggggcctcggggatgaccagacgaaaattggcgccgtgtaaaaaagt

SEQ ID NO: 276719 - DNA, 1770 bp, Homo sapiens
ggctgtcgggtccggggcgcgcgctgatgcgaacggggtgacagatgggaacgcctccgagaccgccagcgacgaccccgctcgggcagccccggatttcctcggctgcaccggcgccggcagcggggaccgaggcccgcgtccgttcgggtcgggccggggcttagccccgcgccccacgggcggccgggaccccacccggaccccgccgcggttctgggccgccggagcctcgcgccgcctctcggggaccttgtcccctggcctccggcctctcgggcccctcgcctgccgtctaggagggaaggggccttggatctgtgccccgcccatggaacagcgcccgggctcggagaggccccgcgaggccgcaggcgcagaccctcccggagggctgggcgggcaccggggtcttcggctggcttgagggacccgacccctgggggaggaatttggggtctgtgtgtccgaatgaacgcgggggttcagatgagtctgtggtgcccccgctttccatctcctccggccccggccccagaggactgtctgagaggccggtggccgcggatcctggacgcgcctccctcctgcctgtggtttccctttattccggcagcggcgcgagcccacccttcacatacaggagctacatccagaagcttctcctggggccacagcgtgggcttccgagactctgcgtgaccccagctctgcccctttggggctgcgggtgaagccctcaggaccctccgcgtgcgttgggcaggtaactggatgagggataatgtggtgaggtccccgtgcccaaccctcctctgcagcccacagcaaccgttccctcttcagcagccccctccccccggccgctctgggcgcccgttcccagcatcctccttggcaggtgttacccctccccattccccaggccctgggccctcctgatctgtctcctcgaccccctggggccccagtctggctcagtctggtccacactctggaatctggtgggactgggtatggagggtcttgagtgtcagcaggccacctgcgtcccacctggtgggtgagaagggtcccacaggtcagcatggagggacccgactctgtctcttctgctggaaaccaggcaggttccttcccccagggccccggcagggccacgagtacccgctgcactggagcacgggggaagaggcagggatccttcattacctgaaccccatgttcacacgtcacaaaacaggagtttccaaaattagaatttatttcagtttctaaggaatgaatccccgagtgtggcaggaaggacacagccggctcctgacgcacacctgatttgattcaacaccgagtcggcacagacacaaccagagatggcctgggtccaggctggggctgcacgggctgtgtcctggacagccaggagggaggccccgcacacagacggccgccgggcagggggcctgagcgggacaggcctggccacagcccatgtccttggccttccacataggtgcacacattgtctgcccagagagggccaagatgccccaggcaccccttcgctccgggggctcaggacacaggctcccagctgaggccacgcctggacccagagctgatgtttggctgcacgcgagcccactcgggacagacccaagaacacgaattctctccctttggatttaaggctggtgttttttgacatttacttcagtttttctctctgaaattaaaattacctgagtaaaagattttaagacattaaaa

SEQ ID NO: 276720 - DNA, 1212 bp, Homo sapiens
ggctgtcgggtccggggcgcgcgctgatgcgaacggggtgacagatgggaacgcctccgagaccgccagcgacgaccccgctcgggcgggcaccggggtcttcggctggcttgagggacccgacccctgggggaggaatttggggtctgtgtgtccgaatgaacgcgggggttcagatgagtctgtggtgcccccgctttccatctcctccggccccggccccagaggactgtctgagaggccggtggccgcggatcctggacgcgcctccctcctgcctgtggtttccctttattccggcagcggcgcgagcccacccttcacatacaggagctacatccagaagcttctcctggggccacagcgtgggcttccgagactctgcgtgaccccagctctgcccctttggggctgcgggtgaagccctcaggaccctccgcgtgcgttgggcaggtaactggatgagggataatgtggtgaggtccccgtgcccaaccctcctctgcagcccacagcaaccgttccctcttcagcagccccctccccccggccgctctgggcgcccgttcccagcatcctccttggcaggtgttacccctccccattccccaggccctgggccctcctgatctgtctcctcgaccccctggggccccagtctggctcagtctggtccacactctggaatctggtgggactgggtatggagggtcttgagtgtcagcaggccacctgcgtcccacctggtgggtgagaagggtcccacaggtcagcatggagggacccgactctgtctcttctgctggaaaccaggcaggttccttcccccagggccccggcagggccacgagtacccgctgcactggagcacgggggaagaggcagggatccttcattacctgaaccccatgttcacacgtcacaaaacaggagtttccaaaattagaatttatttcagtttctaaggaatgaatccccgagtgtggcaggaaggacacagccggctcctgacgcacacctgatttgattcaacaccgagtcggcacagacacaaccagagctgatgtttggctgcacgcgagcccactcgggacagacccaagaacacgaattctctccctttggatttaaggctggtgttttttgacatttacttcagtttttctctctgaaattaaaattacctgagtaaaagattttaagacattaaaa

SEQ ID NO: 276721 - DNA, 1457 bp, Homo sapiens
ggctgtcgggtccggggcgcgcgctgatgcgaacggggtgacagatgggaacgcctccgagaccgccagcgacgaccccgctcgggcgggcaccggggtcttcggctggcttgagggacccgacccctgggggaggaatttggggtctgtgtgtccgaatgaacgcgggggttcagatgagtctgtggtgcccccgctttccatctcctccggccccggccccagaggactgtctgagaggccggtggccgcggatcctggacgcgcctccctcctgcctgtggtttccctttattccggcagcggcgcgagcccacccttcacatacaggagctacatccagaagcttctcctggggccacagcgtgggcttccgagactctgcgtgaccccagctctgcccctttggggctgcgggtgaagccctcaggaccctccgcgtgcgttgggcaggtaactggatgagggataatgtggtgaggtccccgtgcccaaccctcctctgcagcccacagcaaccgttccctcttcagcagccccctccccccggccgctctgggcgcccgttcccagcatcctccttggcaggtgttacccctccccattccccaggccctgggccctcctgatctgtctcctcgaccccctggggccccagtctggctcagtctggtccacactctggaatctggtgggactgggtatggagggtcttgagtgtcagcaggccacctgcgtcccacctggtgggtgagaagggtcccacaggtcagcatggagggacccgactctgtctcttctgctggaaaccaggcaggttccttcccccagggccccggcagggccacgagtacccgctgcactggagcacgggggaagaggcagggatccttcattacctgaaccccatgttcacacgtcacaaaacaggagtttccaaaattagaatttatttcagtttctaaggaatgaatccccgagtgtggcaggaaggacacagccggctcctgacgcacacctgatttgattcaacaccgagtcggcacagacacaaccagagatggcctgggtccaggctggggctgcacgggctgtgtcctggacagccaggagggaggccccgcacacagacggccgccgggcagggggcctgagcgggacaggcctggccacagcccatgtccttggccttccacataggtgcacacattgtctgcccagagagggccaagatgccccaggcaccccttcgctccgggggctcaggacacaggctcccagctgaggccacgcctggacccagagctgatgtttggctgcacgcgagcccactcgggacagacccaagaacacgaattctctccctttggatttaaggctggtgttttttgacatttacttcagtttttctctctgaaattaaaattacctgagtaaaagattttaagacattaaaa

SEQ ID NO: 276722 - DNA, 1023 bp, Homo sapiens
ggctgtcgggtccggggcgcgcgctgatgcgaacggggtgacagatgggaacgcctccgagaccgccagcgacgaccccgctcgggcagccccggatttcctcggctgcaccggcgccggcagcggggaccgaggcccgcgtccgttcgggtcgggccggggcttagccccgcgccccacgggcggccgggaccccacccggaccccgccgcggttctgggccgccggagcctcgcgccgcctctcggggaccttgtcccctggcctccggcctctcgggcccctcgcctgccgtctaggagggaaggggccttggatctgtgccccgcccatggaacagcgcccgggctcggagaggccccgcgaggccgcaggcgcagaccctcccggagggctgggcgggcaccggggtcttcggctggcttgagggacccgacccctgggggaggaatttggggtctgtgtgtccgaatgaacgcgggggttcagatgagtctgtggtgcccccgctttccatctcctccggccccggccccagaggactgtctgagaggccggtggccgcggatcctggacgcgcctccctcctgcctgtggtttccctttattccggcagcggcgcgagcccacccttcacatacaggagctacatccagaagcttctcctggggccacagcgtgggcttccgagactctgcgtgaccccagctctgcccctttggggctgcgggtgaagccctcaggaccctccgcgtgcgttgggcaggtgcacacattgtctgcccagagagggccaagatgccccaggcaccccttcgctccgggggctcaggacacaggctcccagctgaggccacgcctggacccagagctgatgtttggctgcacgcgagcccactcgggacagacccaagaacacgaattctctccctttggatttaaggctggtgttttttgacatttacttcagtttttctctctgaaattaaaattacctgagtaaaagattttaagacattaaaa

SEQ ID NO: 276723 - DNA, 1020 bp, Homo sapiens
ggctgtcgggtccggggcgcgcgctgatgcgaacggggtgacagatgggaacgcctccgagaccgccagcgacgaccccgctcgggcagccccggatttcctcggctgcaccggcgccggcagcggggaccgaggcccgcgtccgttcgggtcgggccggggcttagccccgcgccccacgggcggccgggaccccacccggaccccgccgcggttctgggccgccggagcctcgcgccgcctctcggggaccttgtcccctggcctccggcctctcgggcccctcgcctgccgtctaggagggaaggggccttggatctgtgccccgcccatggaacagcgcccgggctcggagaggccccgcgaggccgcaggcgcagaccctcccggagggctgggcgggcaccggggtcttcggctggcttgagggacccgacccctgggggaggaatttggggtctgtgtgtccgaatgaacgcgggggttcagatgagtctgtggtgcccccgctttccatctcctccggccccggccccagaggactgtctgagaggccggtggccgcggatcctggacgcgcctccctcctgcctgtggtttccctttattccggcagcggcgcgagcccacccttcacatacaggagctacatccagaagcttctcctggggccacagcgtgggcttccgagactctgcgtgaccccagctctgcccctttggggctgcgggtgaagccctcaggaccctccgcgtgcgttgggcagtttctaaggaatgaatccccgagtgtggcaggaaggacacagccggctcctgacgcacacctgatttgattcaacaccgagtcggcacagacacaaccagagctgatgtttggctgcacgcgagcccactcgggacagacccaagaacacgaattctctccctttggatttaaggctggtgttttttgacatttacttcagtttttctctctgaaattaaaattacctgagtaaaagattttaagacattaaaa

SEQ ID NO: 276724 - DNA, 1570 bp, Homo sapiens
gaattccgggggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccacttcctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtacattattttcatagattaaataaatgtctttataataccaaaaaaaaagtt

SEQ ID NO: 276725 - DNA, 1148 bp, Homo sapiens
cccgggccggggctgtagactagagagggagagaagaaaacccaaaaatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccacttcctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtacattattttcatagattaaataaatgtctttataataccaaaaaaaaagtt

SEQ ID NO: 276726 - DNA, 797 bp, Homo sapiens
aaagattcggtcctttctgccccaactctaggagaagaggaagaattcagagctagggaggaagaggggtgaagaacaatctttctgaccctcgctccggttgagttggaaagttccgaattgaggggtccactgggagggcttggaagggggatctgaggttccggcgccgaagggagccgctctccgccccctgcgtggcccgtgggcggctctgaatgctttgccctgacccgggccggggctgtagactagagagggagagaagaaaacccaaaagcagtaaagcgagcggctttggggtgggggcgggggtggggtggcgaggaaggggagaggtgatactggttttggaggatggggtagtccgaactgaggttgggctgagtacacggcccgctatgacgccgagcctgttttccctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgg

SEQ ID NO: 276727 - DNA, 1512 bp, Homo sapiens
gaattccgggggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccacttcctttcttcttcttctaaaatattgggcactcggttatcttttaaaattctctagggggactttcttaaaaataactagagggacctattttcctcttttttatgttttagactgtagattatttattaaaattctttaataataggaaaaggggaaagtatttattgtacattattttcatagattaaataaatgtctttataataccaaaaaaaaagtt

SEQ ID NO: 276728 - DNA, 981 bp, Homo sapiens
agaggtgcctctccagcgaccacctctgccgacactatatccctcaggacctgttcgattcaactcctccgccggcctcctctctggcgctcgggacactgtcgagcttcgccgactagcaacgacccacgtagaggccttgggagctcctccgtggtgggacattgttccaagaaggggcgcgtccgacgtcgttgccgtccagctctgcaccacctgaccgtgacgtcgtaagagtagcgtgccagggaagccacgcagccgctacttaaggagcccgcacgaggctagcccccccgcccacgctctctatcccgcccacttcgcactgatttcacgcagccattggccaagacggggtgtcgccgtgttgcccaggcaggtcttgaactcttggcttctggcttcaagtgatcttccagcctcggcctcccaaagtgctgggattacagtcagccactgcaccggaaatgttttcaaccgtgacccataaaggcccagaccgagccataattccagaaatggagtggacgagccaggccctgctgacagtggacatagtggactcagggaacctagtcgaaatcaccgttttcgggcggccccgtgtacagaatcgggtgaagagcatgctcctgtgcctggcatggtttcaccgagaacatcgtgcccgagctgagaagatgaaacaccttgagaagaacttgaaggcccatgcatcagacccccactctccccaggatcctgttgcttaagacaacatagttactgttgggaacatcttaactttctaacttttgctgctaaagttgaagaaaagcaagtatagcattcttaaatccccgtattcctttttcctgtgtcttgatggattgtggtttattttgttgcaagagtgagtttgaactattctaataaagaaatggctattttgccaaaagcattaagatcttcacacacttataataaagcaaatttata

SEQ ID NO: 276729 - DNA, 624 bp, Homo sapiens
ccagttttatagaggagaaaacagaagcccggggaggctagaactcgcctaaggtcacacagcttggatgtagtgcagccacagcgggtgcctgagaaaaaacagtttgtgggacacatcacgtttctgccaagtgctacagctgaagcccatattcatagaagcaccctgacagcccttctccagcaacttccagaaaacagaacctgagcactcaaagctgcatcagcccatgtggccttgctcccagagaagcatctgccagtttgggcatggaggaacagaaagtgggcagggaattctccttggctccttagaaggcagtgggagcccagggaagcgttcggccccagtgcagcctaattgggagggagggatgggtagaggctggctgggcttctccttcctcaccctcatgcaaggtggctgcccctctggctccttcagagctcttcccttccaagttcctactgagaaataagaaggcacaaaggaaaatcagccacctcctggaggtcactgtgggccacctgctttgctaagagccaagcacagacccctgcattctccctgcaggagagcccacccggctcagaagaaagcaattccgcctgtggggaggag

SEQ ID NO: 276730 - DNA, 1810 bp, Homo sapiens
  misc_feature (1)..(1): n is a, c, g, or t
  misc_feature (3)..(4): n is a, c, g, or t
  misc_feature (1810)..(1810): n is a, c, g, or t
ngnngatcctgggttctgtgcatccgtctgtctgaccatccctctcaatcttccctgcccaggactggccatactgccaccgcacacgtgcacacacgccaacaggcatctgccatgctggcatctctataagggctccagtccagagaccctgggccattgaacttgctcctcaggcagaggctgagtccgcacatcacctccaggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttccacatggcaaggggtctccttggan

SEQ ID NO: 276731 - DNA, 1887 bp, Homo sapiens
  misc_feature (1887)..(1887): n is a, c, g, or t
cgccaccgcccagctgcccaggagcccagccaggactggccatactgccaccgcacacgtgcacacacgccaacaggcatctgccatgctggcatctctataagggctccagtccagagaccctgggccattgaacttgctcctcaggcagaggctgagtccgcacatcacctccaggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggtgggtgtagccgtggctagggctgacggggccacttgggcttggccgcatgcccctgtgccccaccagccatcctgaacccaacctagatcctccacctccacaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttccacatggcaaggggtctccttggan

SEQ ID NO: 276732 - DNA, 1729 bp, Homo sapiens
  misc_feature (1729)..(1729): n is a, c, g, or t
gctgcccagccccatctttcttggcccccgaggggtggctgcccaggcctctctcctggcacagttccatgtagtgcctgcccatgtggctcccagttcctccccggggtcctggctgagcagaatggcactggatcctgatctggcttcttgcatcccagaggagaccgccatgcgggcccttcctccagattcttccctagtttaacaacaggaagcgaggagtccaggggggcagagattgccacgggcctggccacattgctaggggaggtcccaacctgctgctgagatccggcactgcacagcctcgttcaggcagagaaactgataaggagatggttgtctgctcaccccaaaaggactggccatactgccaccgcacacgtgcacacacgccaacaggcatctgccatgctggcatctctataagggctccagtccagagaccctgggccattgaacttgctcctcaggcagaggctgagtccgcacatcacctccaggccctcagaacacctgccccagccccaccatgctcatggcgtccaccacttccgcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggtgggtgtagccgtggctagggctgacggggccacttgggcttggccgcatgcccctgtgccccaccagccatcctgaacccaacctagatcctccacctccacaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttccacatggcaaggggtctccttggan

SEQ ID NO: 276733 - DNA, 1781 bp, Homo sapiens
  misc_feature (1781)..(1781): n is a, c, g, or t
cgccaccgcccagctgcccaggagcccagccaggactggccatactgccaccgcacacgtgcacacacgccaacaggcatctgccatgctggcatctctataagggctccagtccagagaccctgggccattgaacttgctcctcaggcagaggctgagtccgcacatcacctccaggccctcagaacacctgccccagccccaccatgctcatggcgtccaccacttccgctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttccacatggcaaggggtctccttggan

SEQ ID NO: 276734 - DNA, 3991 bp, Homo sapiens
aagctggcggccgcggcagggcgggcgccgcgcggaggcagggcgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcatgaaacttctctctatacaaattgaaatacataatgctttctggttcttcttcaaaccaaaacttgtcaaattcatagacaagataacagtaaaactgatgaaagtgttccattgttggtataccaggaacaaggttatagagatgaaacttcaaagcttcactcttcagtaagctataagccatctctgtaagattgattccaactattgcataagaataccctaattttggatgatttgaacgggaaagaatctgatgagcttcactagtgtaattttcactgaaatacacaagattgattaacccaagtatgcccatgcctctgaagtctgtcttgggatcatcaccctgaaaaccaatttcagcccactgcttggagattctagcgtttaacttcttcgtgggcattagaagattccaaagcttcatgagtagctcttcatgctgtaggttatcagaatcatatggccttttcctcacactttctacatccaaatacagctgtttataaccagttatctgcagtaagcacatcttcatgcatattttaaaactggcatccttctcagggttaatattcttttccttcataatatcatctacatatttgtccacttcactctgaacaacatgtgtcgccttctgtaaaaccttattcttggagtatgtcaaggaattttctatcctgtgtgtcctttgtgcacctacataggtatcaaatattcgctgcaattcacacttcccagtcatctgtcgtaatagccatttcatccaaaatcgaaaaaagtgcccatagaagaactcccacaaagaaataaacatttttttttcctcacaggagcggaagaactagggggagcaggagctgcaatgcggccgc

SEQ ID NO: 276735 - DNA, 3030 bp, Homo sapiens
  misc_feature (1898)..(1898): n is a, c, g, or t
aagctggcggccgcggcagggcgggcgccgcgcggaggcagggcgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggtaactatacatatttagatatagctggttagaaaaatgccactgtttttatcaagaagggaaatatatttgaaatataaaatattaaaattatgctcatttctatttttaaaaataatttaagaaattttacccttgttttcccttgttatggctcttctaattctcatttaattttaggatgtaaaaagtatatttttgcagaacaggcagcagcaataacttgtttctgttcttatgtaaataagaatccattattcgctcatgtggaagcttcttttgcatcatttgggactgccatttaaaaaaggataggtaaacaaagaaatgacaaaaataaaataaataaaataaaaatggataggtggtgacccactgagcctgatcataatacgaagaccagcttctgccactgcctttccagactcttaccactgcctgttgattaaatctaactcttcaacatcctagacaggcccttataatcttgcttcaaatgctgtgcagccatcttgcctcaacttccctctcatttgcctacagcatctcgggacgcttctgtgtttcccaagtatacgctgttctttcgctctttgtgcntcgccagtgctttccatgtgcctcgtagagttatttttcttgaagaggcagctcaaatgtcaccttctccagaagctgctctccacttgctttaggcagagtcagtcacttttcttctagattccaaagtgcctgatccacttggttgtggattcctggagcctagcaccacaccagaagcacgaggcccttgagaactgtgtgttgagtgaactaataactgtattatagaaagcataatgaaaatgtcctgtgactgaagtatgtgtagcttgttgcaggagttcacaggaaagttgactaggattgagtgtgttgggctttgggtataaaggagggggattctacgggggcagtagctcaacaaggaatagagggaggagtgtaattttggtagctggtgttgaatagggcctttgagaatcagactgaacacagtgaaatatgtgcccaaagttcagaaagatgaagtttccagaaactaagaaggtagcacaatatgtggcatcatactcagaaaggaagaccatgccatggggccagaaattcagaaacgtaattcttacattgtgattgcaatggatactcatggaagaaagtgggtagtggccgatttgacttcagagtgacaggtagagaagggaagagcgtgtagaactgtggccagactttaggagtgtgagggatgctgaatctcccagagagctcacactggccaggaatgctgagagtagcagatgcttttcttttgggaggatagtaaaacaatttagaaccagatatgctttgtcttgattctcaagtagaataatcttcaaatgcaaaagaatacattagaaatggacaaaagtggccaggagcggtagctcatacttgtaacccagcactttgggaagccgaggcgggctgatcgcttgaggtcaggagttcgagaccagcctggccaaaatagtgaaactcacgtttctactaaaaatacaaaaattagctgggtgtgatggccacttgggaggctgagataggagaatcgcttgaacctgggaggcagaggttgcagtgagccaatatcgtgccactgcattccagcctgggtgacagaatgaaactccatcactccatctcaaaaaaaaaa

SEQ ID NO: 276736 - DNA, 692 bp, Homo sapiens
aagctggcggccgcggcagggcgggcgccgcgcggaggcagggcgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttaggtaagtgattctaacccattaacagtaacaagatttacattt

SEQ ID NO: 276737 - DNA, 440 bp, Homo sapiens
atggaagatctttgcccaaaagacaatgttattgaaattaaattacagtagaaatgtttggttttcatttcagtgtatgctggaaaaagttggaaattggaattttgatatctttctatttgatagactaacaaatggtaagtgaagaatttgacttgctcaagttaatgtagtctagattactgcattgatggtgcagccgctggtgcgttgctttcatttactgtactaaggttgttagccctctgctggaagagagtgtattagtccattttcacactgctgataaagacatacccgagactgggtaattgagaaaaagaggtttaatggactcatagttccatgtggctggggaggcctcacaatcatggtggaaggtgaaaggcacatcttacatgttggcaggcaagagagaaatgagagccaagcaaaagggg

SEQ ID NO: 276738 - DNA, 184 bp, Homo sapiens
cccctgtcatccctgagcagctgtacctgggactcgggggaggggaaggttggtaggtaagctgtaacagattgctccagttgccttaaactatgcacatagctaagtgaccaaacttcttgttttgatttgaaaaaagtgcattgttttcttgtccctccccgggtacaggggtcaccggagc

SEQ ID NO: 276739 - DNA, 3133 bp, Homo sapiens
  misc_feature (3)..(3): n is a, c, g, or t
ggngatcactgttggaaggcagctgcttgaggtccaaggcagtcagtgtcccctctcttttgcctcgggacagctggtatttatcagactcctaagaagttttccttgctccctagtagaagagagagattatgcagcgggcttttgattgatccaatgggaattacattgatctggtgtctggccttggttcttatcaagtggatcacctctaagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcat

SEQ ID NO: 276740 - DNA, 3079 bp, Homo sapiens
  misc_feature (3)..(3): n is a, c, g, or t
ggngatcactgttggaaggcagctgcttgaggtccaaggcagtcagtgtcccctctcttttgcctcgggacagctggtatttatcagactcctaagaagttttccttgctccctagtagaagagagagattatgcagcgggcttttgattgatccaatgggaattacattgatctggtgtctggccttggttcttatcaagtggatcacctctaagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaatgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcat

SEQ ID NO: 276741 - DNA, 3358 bp, Homo sapiens
agcggagggtccgcggctgcaaagtgtgaattacgccgggctcgcgccggcggcggagtgaagtcaggctccgggggaggggaggagcagaactccggcggcggcggcggcggcggcggcggcggccgagctggtcgctgctcctgagtcccgcgcgccctgggtctggccgctggctccagctgtcttttcttgcactgctttgctccgttcgtgctgcgctcgaactctgcagtccgggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctagcatgaaggaatggccacaggacaggtgactagtcattgtgggatggaattatagtcgatgaagtgagccttggaggaagtcatggtcctactcagagaaacagagagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcat

SEQ ID NO: 276742 - DNA, 2481 bp, Homo sapiens
aatgacgtgaagggggaggagattaccaccactaccattggctgctaattcaaaactactgtgatggcgtagagcttattttagatatatctgtgattcattattcttttgtcacacttcagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcat

SEQ ID NO: 276743 - DNA, 758 bp, Homo sapiens
  misc_feature (77)..(77): n is a, c, g, or t
  misc_feature (87)..(87): n is a, c, g, or t
gccttactcgtggatacatcatcgcattactcgtacggggctatcaccctctgaggcacagctttcctgactggttncgattgtctntgatgtatcactggcctggtccacattcactctgtacgtacagagtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcat

SEQ ID NO: 276744 - DNA, 2604 bp, Homo sapiens
  misc_feature (3)..(3): n is a, c, g, or t
ggngatcactgttggaaggcagctgcttgaggtccaaggcagtcagtgtcccctctcttttgcctcgggacagctggtatttatcagactcctaagaagttttccttgctccctagtagaagagagagattatgcagcgggcttttgattgatccaatgggaattacattgatctggtgtctggccttggttcttatcaagtggatcacctctaagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtgtgaatgtacggatgtgtgtttgcgtgcatgtatgca

SEQ ID NO: 276745 - DNA, 2806 bp, Homo sapiens
  misc_feature (1898)..(1898): n is a, c, g, or t
aagctggcggccgcggcagggcgggcgccgcgcggaggcagggcgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggtaactatacatatttagatatagctggttagaaaaatgccactgtttttatcaagaagggaaatatatttgaaatataaaatattaaaattatgctcatttctatttttaaaaataatttaagaaattttacccttgttttcccttgttatggctcttctaattctcatttaattttaggatgtaaaaagtatatttttgcagaacaggcagcagcaataacttgtttctgttcttatgtaaataagaatccattattcgctcatgtggaagcttcttttgcatcatttgggactgccatttaaaaaaggataggtaaacaaagaaatgacaaaaataaaataaataaaataaaaatggataggtggtgacccactgagcctgatcataatacgaagaccagcttctgccactgcctttccagactcttaccactgcctgttgattaaatctaactcttcaacatcctagacaggcccttataatcttgcttcaaatgctgtgcagccatcttgcctcaacttccctctcatttgcctacagcatctcgggacgcttctgtgtttcccaagtatacgctgttctttcgctctttgtgcntcgccagtgctttccatgtgcctcgtagagttatttttcttgaagaggcagctcaaatgtcaccttctccagaagctgctctccacttgctttaggcagagtcagtcacttttcttctagattccaaagtgcctgatccacttggttgtggattcctggagcctagcaccacaccagaagcacgaggcccttgagaactgtgtgttgagtgaactaataactgtattatagaaagcataatgaaaatgtcctgtgactgaagtatgtgtagcttgttgcaggagttcacaggaaagttgactaggattgagtgtgttgggctttgggtataaaggagggggattctacgggggcagtagctcaacaaggaatagagggaggagtgtaattttggtagctggtgttgaatagggcctttgagaatcagactgaacacagtgaaatatgtgcccaaagttcagaaagatgaagtttccagaaactaagaaggtagcacaatatgtggcatcatactcagaaaggaagaccatgccatggggccagaaattcagaaacgtaattcttacattgtgattgcaatggatactcatggaagaaagtgggtagtggccgatttgacttcagagtgacaggtagagaagggaagagcgtgtagaactgtggccagactttaggagtgtgagggatgctgaatctcccagagagctcacactggccaggaatgctgagagtagcagatgcttttcttttgggaggatagtaaaacaatttagaaccagatatgctttgtcttgattctcaagtagaataatcttcaaatgcaaaagaatacatgagccaatatcgtgccactgcattccagcctgggtgacagaatgaaactccatcactccatctcaaaaaaaaaa

SEQ ID NO: 276746 - DNA, 857 bp, Homo sapiens
aagctggcggccgcggcagggcgggcgccgcgcggaggcagggcgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggtaagtgaagaatttgacttgctcaagttaatgtagtctagattactgcattgatggtgcagccgctggtgcgttgctttcatttactgtactaaggttgttagccctctgctggaagagagtgtattagtccattttcacactgctgataaagacatacccgagactgggtaattgagaaaaagaggtttaatggactcatagttccatgtggctggggaggcctcacaatcatggtggaaggtgaaaggcacatcttacatgttggcaggcaagagagaaatgagagccaagcaaaagggg

SEQ ID NO: 276747 - DNA, 413 bp, Homo sapiens
aatgaaatggcctaaggatgaactctgtaaactccacatgggcagggccactgttgtatcatggctttgccagtgtggtgatgagatcaggacctggcagatgtgcttggtgaacctaatgaacaaccacctgaggaatgacgtgaagggggaggagattaccaccactaccattggctgctaattcaaaactactgtgatggcgtagagcttattttagatatatctgtgattcattattcttttgtcacacttcagcttgccaattctgtaactccttgggatatcttgctgagcttaattgcagctgccactcatgatctggatcatccaggtgttaatcaacctttccttattaaaactaaccattacttggcaactttatacaaggttagtgcaattttatcatcaag

SEQ ID NO: 276748 - DNA, 3214 bp, Homo sapiens
aagctggcggccgcggcagggcgggcgccgcgcggaggcagggcgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctagcatgaaggaatggccacaggacaggtgactagtcattgtgggatggaattatagtcgatgaagtgagccttggaggaagtcatggtcctactcagagaaacagagagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcat

SEQ ID NO: 276749 - DNA, 2979 bp, Homo sapiens
ggcctggtctctctgccaacatccagcaagatgtaatacaaggaatatgttttctttcagtgtttctcatgtcaacacaaatgcagttttttccattttctttttactcttgggacacagtcatgttccagtccatctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaaggctgaactcatgtggattataaagcattttgttcaagttgagcccaaagtctccttgattgattgacactgcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcat

SEQ ID NO: 276750 - DNA, 3616 bp, Homo sapiens
  misc_feature (3)..(3): n is a, c, g, or t
ggngatcactgttggaaggcagctgcttgaggtccaaggcagtcagtgtcccctctcttttgcctcgggacagctggtatttatcagactcctaagaagttttccttgctccctagtagaagagagagattatgcagcgggcttttgattgatccaatgggaattacattgatctggtgtctggccttggttcttatcaagtggatcacctctaagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcatatttttatctttgacatttaccttataactcaatcttttggaaaacacaatgctaaattacaaggaaatcaaagttagcttcttggctcttgtaattcatccctcagatgtttactcagtccgagcttatctactaatgactcaccttgcaagtgagtaagcagaagcccagttagggctgttggagtcctgactaacacaggggagaggtcagctttgagccaggccttttgttcctacagtggtgaactgcataagacatcagcaagtcttgcaagtactaaaatactagttgtatttatttctatcaatcattggcctttttaaagtgataagaaaaggccactccactctacttgattgatatcagttgtaaacaaggtaccactgtgccattccctatatcttcccaggtccaactcattagaagggatatggtgcaaacttctaaatcaaacacattaacatattatttgtacagaa

SEQ ID NO: 276751 - DNA, 1253 bp, Homo sapiens
aagctggcggccgcggcagggcgggcgccgcgcggaggcagggcgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggcaagttacagtattgagtgataattaatctatcca

SEQ ID NO: 276752 - DNA, 510 bp, Homo sapiens
aagctggcggccgcggcagggcgggcgccgcgcggaggcagggcgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggatgctggccttataagatgagttaggaaggagtccctcctcctcaattttttggaacaatttcagtaggaatgtaccagttctcctttgaacatgatgatcctactgacctatctcgggcccttc

SEQ ID NO: 276753 - DNA, 734 bp, Homo sapiens
tcagtcttgggctttttgacttctaggtgaagtggcatctcccagtagaagcatccgctgggcagctgcagtggtaacaccgggtgatgatatttgaagtcatcaatcagagcctcccctgccgagaggttctttgtgaggagtggaaaggggtgcgccctctgggccagggacagggcttgctgaactcggttttagcctcaactttttctttcctcctcagccagatgcctttatagatggagcacctgacctcatgcaagggccctcatcactgaagctggagacgaaattggttcttagagagtgtagaaagggacgactgagaactagccccggggcatgattgcaggggaccctgttttctctcttgtgacacctgttgtagatatgtgaaatgagacagttatgcttgtccctcttcacagcagaaggggaaaagtcaaactgggaatgcatcacatggaggccaggagaaaagtcatggaaccactaattctgtttttacactcacagtaatctaagccagttctttacacaacctcttactcgttgaataatagcgaaaatttaagctaacatattctttcttttgaaaacaaacatgtttaaacattttagatgtgggtatgtctgtcttggaaattaccaataaaatatttctcccagccttgtttcgccatgggccagtagggtgcgtcaggaccagcactaatatctttaatctcctcagt

SEQ ID NO: 276754 - DNA, 471 bp, Homo sapiens
atcatttccttcacaatacacatgagcctagaaagggagagagagaaaaaatcaacattagtataggttcagccctgacatcctaaatgaggctctaaattttcttatggctcaagtcatcattctacagcaacatcaacattcatctcccaaggaaagaattgcaaacctatgttctaccagtaacctgggtgtaaccttactataaatgaaaacatgcttccttttttttaactatacaaaagattctgagttaggctgcgcatggtggctcatgcctgcaatcccagcatttcgggaggctaaggtgggcagatcacttgaggcctgcttatctgttttacttgtgtcccaatgtcccccaaatacccacctcatacatgaggccgtatgggataaaggttagttaagtgctcaagggtctgtgcctaatttagagcctagctctgctgcttttctctgtggaaactt

SEQ ID NO: 276755 - DNA, 2300 bp, Homo sapiens
  misc_feature (1)..(1): n is a, c, g, or t
  misc_feature (2009)..(2009): n is a, c, g, or t
  misc_feature (2075)..(2075): n is a, c, g, or t
naaatatctgaaattttgatgccgctttgctcacaatgtcatcctttatcctttaaacctggagttgtctgaggtggtttgcaaactgcaaagcgccctgttcccaatgatgcacctgagaagtctgtaaatggggtaaatttaggcaaacacacctggaaaagtggcattttggagtggggaatgctgtggccggaggttagcaaccggatgatgcaaaagcgtatttaaggcagcagttctggcctttccccgccatggagcagaagcccccatagtgatgtgagaagcggcgctgtcccagtttactaggatgggatgggctttggatctaaccagcagcgaagaaaacctgcggtgcggctgcgctcggtagtaggggtccacaaagcgtcagaatctgcagcagccccggcctttgcgagctccagctccgaagtcaacccggcccccaaattccactgggaaaccttaagacaccggtgtttttaccgtaagaagacctcagaagcccatggaaacaaggcgatgacggcgcttgagggtgaccagacctcctcaatcattccatcagccacccaggactcaacagcagaacctcagaggactcagctgaaagaggttttcactcgagcactaaccacagagaaatgggaagtgccatcctgctgtcatacgcagccgatggctgggtaggactaaatgcccttctgtggtgagatgaaccaagacggcagatgggggaataacatcagtgagagagagattacgaatggatccttgtattgcagatcaaactgggttgtctcttctcaaaccacccaggcagtttctgaatgtcccaagataggggtaggagaaaagaaaaaaaagacaaaacaggagacggtgggtaagaaaacctaaaaggcacaatgaggcaaaggcctaagatggaggctggctttgggatctgaaatccggccacaatcctccttgttttacctcaagtccaagaattgtcaaaaagaaaacccagaagggctattcattctaaattttaaaatcttttcttcctggcctaccaagtccttgtgttttctttctaggcgcccataaatacaaccccattacagttctatttggctaataatttacagaacatttaaaataccgggtaggtgaacatctcttcatggcttttgtgtaagggcctgaagcgaagagaaaaacaactgattggagattcctatctggcgccttctccagggaaactgacaaccagagaaatctgttgctaggatttctaggacatctggaaattccctttttgttctttctcaacaatataaaatggtatattcgcaaacctatctgaatcacctcaatctaggccactttgaaaatttcatttaaaaatgtaatcacagatttttaaactaattacccaatttgcaaacaaatcccagctacttctggtcttgaacatggagcaaaggtgtgtcagtaaggccaacattcttaggttgacagagacaggttaacacattggctggctcagcctgtgaaaaagaaccaatgatgatgcacaccctggctgaagtgacatctggccaaaggattccaacagaatgaattccatcaacatggaaaagataatccatggcaccaattctgtgctgcttacaggcaatggttaccaaatgagtcaaaacatggcctagaagtggagccgggcccaatgaaaagcctgagttcacacgtgctaggggctccactgaccggcctctgcagcccagcacccagtcctcttgctctgggtgcaaggtgaggaggcagagtgcacacaccggctcctgtgtccccggcctggctggcaatggtaaaatgggctgcctttcttttgcagcttcttctaatcgaaataccaaagggtactgacctctggcctcagggatgtgacttgcagtgcaaattttacctcttcagtgcagagagtggtcttgaaatcttgccagtgtgtggccctncctcagctcctgccaccctggggagccaggatgctgaaatgcataaggcaaaagcactgaatcggntctattccccactgacctttagttacgatcactctgccctgaccagctggagttgggcctgtgtgaagccagtgatttccaacacactgaagaaggtatctgagtccagtgtgaaagccaaattcctcctgaatctgtgatttggtgaagctctgtgaggtattttttgtgtgtggaagactgaaagtgaagggaaacaactaaaaaaattaaacagacaaaagc

SEQ ID NO: 276756 - DNA, 338 bp, Homo sapiens
ccaacatggcccggcccgggagaactgtgcctaccgccagggtgggacctcccatgccaccattgtcctagacctcccacagtgcccacccccagtaggctcctaagagaggggccaggggctggactcaggcctcccacccatgcccatggggcatagagttgccgggaaagcttcctggttcataccggacctgacctcccaggaagtgcccgtaacttggggctcccatgttaagtctggatctgggcggggggagaccagagctgttggggcttggttgccccatttggcctctcctctctgccctccccttccagctgccccagagcacatca

SEQ ID NO: 276757 - DNA, 846 bp, Homo sapiens
  misc_feature (186)..(186): n is a, c, g, or t
  misc_feature (192)..(192): n is a, c, g, or t
  misc_feature (198)..(198): n is a, c, g, or t
ggccccaggagagcttgtgtgccccactggctgggctccaggcaggattcctccatccccgtgcctgaccacactaggagactgggcagaccccactcacagacggggaaaagcctggcttcgctggtggcaccagagggaagagccaagtctacagtaaaatggcaagtccctgggccagaatgncagacncatccntgaccaaccacctggctaggacctcactggtataaacaaacacccaccaaccaatgcagggtgcccattaggggcactggatagccacagaactcctacttctttctcttgttaaatagaagttctagtctctgccacatacatcttagaggcccaggtggcactgaggtcacaaacgggtggcatgaggggagctaatcttgactgcttttcaatgtccctcagcatgaataacaaacaggcctactgtgctggaatctgctgctcgttcatttacagaatgtgcacttaatggtgaatgtaaggccgggcgcagtagctcacgtctctaatcccagcactttgggaagccagcaggtggatcacctgaggtcaggagttcgagaccagcctggccaacatggcgaaatcccgtctctactaaaaataagaacattagccaggtgtggtggcacatacctgtaatcccagctacttgggagactgaggcgggaggatggcttgagcccatgcagtgaactatgaatgcgccactgcactccagcctgggccaaacagcaagaccctgtctcaaaaaagagaagaaaagaaccactggacaggctgagagatacagtcctacaatctctgcccccaaccccaatctct

SEQ ID NO: 276758 - DNA, 643 bp, Homo sapiens
taaaataccaaactgagctaaatacggtatatgtgtacttatacatatgtacataacctaaatatacgtgtgcacacattatctatacaaagagccatactcagtgaaagataaattacctcctaaactaaagtcccctctgaggtacaacagaaattaaaataattgcttctcttctcaactctatgtagcacgtattttccatgatgggataaatgttttcatttcaagtgccaatgtgtgaactgtaataaacattactgctttcattttttgtaggtatggaggttacattaactgttatagttgcggagctgagtttttatgtcaggtaattttgtttagtccaaactggttttgaactataaacaattatggatatgtattttttggtttctttgaccccaaagggaaattggggtttatgtcaaattgatgttttatcaaaataaatctgtttctcaaagcaaaagtctctgtaggattgagataattcattatttacatatagggtaaacagacatttactgcctattgagatcataattgagataatggattatctcaatcctggattctaatttactacaaataatttagcaccattatttaacagagcagtttaaaataataatctttcctt

SEQ ID NO: 276759 - DNA, 552 bp, Homo sapiens
taagccaacagaaatagcaaagcaaatgacccaagcttcaactatcaactatttaaaagtgaagatcttttgaaggagtaattatattcttttatcatcaagaaaggtatggaggttacattaactgttatagttgcggagctgagtttttatgtcagatgctttcaatcttctgaagatctcattgagaaccagtcattctaatcattgttttcacacactatggaaatcattagaataaaaatgttgaagattgatttaaaatgaaagtttccaagttttgttatataatatttagcattttaagttggctgctgcttcctggaactaaactacttggactaggaagacctactttgctgacattgtcacaactaactgagcgactaaggccagttttacccaaggttagaggtggaggtggttttaaagttgtgaggaccttgccattattattaccagaaggaagactggatgatattttgggctcttgcttaatggaaatgttttttgtgcttgaaattttgggtggctccacatcctaaaagatga

SEQ ID NO: 276760 - DNA, 354 bp, Homo sapiens
atagtctgaaatatagcctcatgggatgagaggctgtgccccagcccgacacccgtaaagggtctgtgctgaggtggattagtaaaagaggaaagccttgcagttgagatagaggaagggcactgtctcctgcctgcccctgggaactgaatgtctcggtataaaacccgattgtacatttgttcaattctgagataggagaaaaaccaccctatggcgggaggcgagacatgttggcagcaatgctgccttgttatgctttactccacagatgtttgggcggagggaaacataaatctggcctacgtgcacatccaggcatagtacctccctttgaacttaattatgacacag

SEQ ID NO: 276761 - DNA, 766 bp, Homo sapiens
acagctcatagtttcattttcatctcctcacccccttcccaggggagcgctgagcagggagtagcccactgccacccttccagaagcccagctacccagaagctggagaacaagtagacaaggggctgaggctggccaggggaatgccctccagggcatgggctgagaaggccttggcaccagggtgctctgctgttggcattttcctgagtccgtcaggagcatatttgtgctctgtgtgttgtttagagctggctgcatctttaaaattgtaagtgccaacttgtgttttgtgtttcaaagttccagaagcaaaaacaaaaaaagttcgggtacagcggctcacacctgtaatcccagctcttagggagatggaaactggaggatcacttgaggccaggagttcaagaccagcctgggcaacatagcaagacccagtctcttaaaagaaaattaaaaagaaagagtaaataaagttccagaagctttgctctccttatccaagcagcgtttgtactttggcactggaaagtgcgggagtcaggggtttgtgagagcacgtgttggttgtcgcattggtcaggatgcacccatcactctgtatcctccggctaaggagtgctggagagccgtgatgcccactggctgttgtcccgggcttgtcactcaaagacgggacagatgtctccttccagttctggcccagactgtcctctgagctgggagcacagggctcctccctgagtagatgacctgtcaggtcagc

SEQ ID NO: 276762 - DNA, 719 bp, Homo sapiens
cttgcccgtgcgtccgtggcacggaacggccgttagtcccggcagagggctccgcgaagacagtgccgtcgttgggcgcgcgcgcgggcgggagctgtcggggcggggcggcaccgccgagctccgagctgcaggactttgaaatgaccctgtcctcagcctggaggatgcggtattctgattgtctggtgctgtgtcaactgggcctgcctctgggatagtgttgtggctgccccacgagaaccctatatgccagttccagaagcaaaaacaaaaaaagttcgggtacagcggctcacacctgtaatcccagctcttagggagatggaaactggaggatcacttgaggccaggagttcaagaccagcctgggcaacatagcaagacccagtctcttaaaagaaaattaaaaagaaagagtaaataaagttccagaagctttgctctccttatccaagcagcgtttgtactttggcactggaaagtgcgggagtcaggggtttgtgagagcacgtgttggttgtcgcattggtcaggatgcacccatcactctgtatcctccggctaaggagtgctggagagccgtgatgcccactggctgttgtcccgggcttgtcactcaaagacgggacagatgtctccttccagttctggcccagactgtcctctgagctgggagcacagggctcctccctgagtagatgacctgtcaggtcagc

SEQ ID NO: 276763 - DNA, 593 bp, Homo sapiens
cttgcccgtgcgtccgtggcacggaacggccgttagtcccggcagagggctccgcgaagacagtgccgtcgttgggcgcgcgcgcgggcgggagctgtcggggcggggcggcaccgccgagctccgagctttccagaagcaaaaacaaaaaaagttcgggtacagcggctcacacctgtaatcccagctcttagggagatggaaactggaggatcacttgaggccaggagttcaagaccagcctgggcaacatagcaagacccagtctcttaaaagaaaattaaaaagaaagagtaaataaagttccagaagctttgctctccttatccaagcagcgtttgtactttggcactggaaagtgcgggagtcaggggtttgtgagagcacgtgttggttgtcgcattggtcaggatgcacccatcactctgtatcctccggctaaggagtgctggagagccgtgatgcccactggctgttgtcccgggcttgtcactcaaagacgggacagatgtctccttccagttctggcccagactgtcctctgagctgggagcacagggctcctccctgagtagatgacctgtcaggtcagc

SEQ ID NO: 276764 - DNA, 459 bp, Homo sapiens
cttgcccgtgcgtccgtggcacggaacggccgttagtcccggcagagggctccgcgaagacagtgccgtcgttgggcgcgcgcgcgggcgggagctgtcggggcggggcggcaccgccgagctccgagctgcaggactttgaaatgaccctgtcctcagcctggaggatgcggtattctgattgtctggtgctgtgtcaactgggcctgcctctgggatagtgttgtggctgccccacgagaaccctatatgccagttttttaagcaaatacagcaaaagttcgggaatagcggctcacacctgtattcccagctcttacccatattcacagaggaggtgtcgcttagagttgattgagttcatctacgccctggtcagcacaccaaggtccagtccgcagggagggtgccccaaacactgagaaaatacccttccagaagctttgctctccttatcct

SEQ ID NO: 276765 - DNA, 337 bp, Homo sapiens
acaataggtgattcagttaggaaattaatgttagagatcggttttccttgtggaaatcagtggtattcaaatgcctgaattggctacccggttttagagctgctctccatgtatgagcaggacataggattcactctctggaatgcttctgtaggcaggactttgaaatgaccctgtcctcagcctggaggatgcggtattctgattgtctggtgctgtgtcaactgggcctgcctctgggatagtgttgtggctgccccacgagaaccctatatgccaggtgagcttgaagcacctcagagacagagcactgaagctccatgacacagggctattc

SEQ ID NO: 276766 - DNA, 486 bp, Homo sapiens
agggaccggagcaccccaggatcgaagagggcgcacgggcccggccctcccacgcgccctccagggacccggcagccagacagacggacaggcggaccgctagggagctcaagtacccggacacacgcacgagcgcagaacaaagggccggacatgctccagcccgctccgcctgcgcctcggccttgcgcgcgggggcccgggttacctgcgcagagccagctgtgatgtaaagaagtttgtgctgcatgagagagatagcacctgaagaaaatgaggccctggaggatgagagactctaaaggaaaagggaagggcctgctgtcttccagccacgccagcccccaactgagaagctgggtgaagccatcttgcatctttagccccagtcaagttacctcagcaaagactagctgaccctgccaagccctgcccaagttacagaatcatgagcaaataaatggctgtttctgttttaagctttta

SEQ ID NO: 276767 - DNA, 532 bp, Homo sapiens
gcctactgcgactactactactaaattcgcggccggtcgaccgagagagatagcacctgaagaaaatgaggccctggaggatgagagactctaaaggaaaagggaagggcctgctgtcttccagccacgccagcccccaactgagaagctgggctggagtgctgtggcacaaccatagctcactgcagcctccacctccctggttcaagcgatcttcccacctcagcctcccgagtagttgagaccacagtgcccttggtgtggtggaagcaaggtgccatgtgataagtaagcctccagagaggcctgcatggcaggatccaatgtctttagccaacagcatctgggaacctgagacctgccaacacccttgtgagtgagcctggaagtggacctcctgctcttgaaccttgaggtgactatagtgctggctgacaccttgactgcagtccctgagctggggggcccagctgatctactcccagaatcccccctactaaaacagtgatataataaatgcttattgtttcaa

SEQ ID NO: 276768 - DNA, 434 bp, Homo sapiens
gcctactgcgactactactactaaattcgcggccggtcgaccgagagagatagcacctgaagaaaatgaggccctggaggatgagagactctaaaggaaaagggaagggcctgctgtcttccagccacgccagcccccaactgagaagctggtgcccttggtgtggtggaagcaaggtgccatgtgataagtaagcctccagagaggcctgcatggcaggatccaatgtctttagccaacagcatctgggaacctgagacctgccaacacccttgtgagtgagcctggaagtggacctcctgctcttgaaccttgaggtgactatagtgctggctgacaccttgactgcagtccctgagctggggggcccagctgatctactcccagaatcccccctactaaaacagtgatataataaatgcttattgtttcaa

SEQ ID NO: 276769 - DNA, 776 bp, Homo sapiens
gccacgtagctcactcttttcttaggctgtgtagttcactttcccagtgcaaactttgggaaaagctctgtgccacaggctccattcctgtttgccacatcacaaataccaatcattgctctaaggagtggatgatttgatgagaatattcagttcttacaccactactagaggaggaacactgactgccttgtcgtggatgtggtctggcagtttctgtaggtaggagtggtggattgtctccaaatgtggccaccgacagtgcctcccattcctgtgtgtgcatgctgcttctcccactagaaggtgtcttttactttccttctctttgcatctggaacttgttttgaccagttggacctagcagaagtggggccctgtgacttccaggccttatgaaatcttgtagcattgtttttcccttttagagccagctgtgatgtaaagaagtttgtgctgcatgagagagatagcacctgaagaaaatgaggccctggaggatgagagactctaaaggaaaagggaagggcctgctgtcttccagccacgccagcccccaactgagaagctgggtgaagccatcttgcatctttagccccagtcaagttacctcagcaaagactagctgaccctgccaagccctgcccaagttacagaatcatgagcaaataaatggctgtttctgttttaagcttttaaattttgggggtggtttatgtgtcaataataactgaaacagataatatatacagaataaactttagttttaataatct

SEQ ID NO: 276770 - DNA, 498 bp, Homo sapiens
agggaccggagcaccccaggatcgaagagggcgcacgggcccggccctcccacgcgccctccagggacccggcagccagacagacggacaggcggaccgctagggagctcaagtacccggacacacgcacgagcgcagaacaaagggccggacatgctccagcccgctccgcctgcgcctcggccttgcgcgcgggggcccgggttacctgcgcagtgcccttggtgtggtggaagcaaggtgccatgtgataagtaagcctccagagaggcctgcatggcaggatccaatgtctttagccaacagcatctgggaacctgagacctgccaacacccttgtgagtgagcctggaagtggacctcctgctcttgaaccttgaggtgactatagtgctggctgacaccttgactgcagtccctgagctggggggcccagctgatctactcccagaatcccccctactaaaacagtgatataataaatgcttattgtttcaa

SEQ ID NO: 276771 - DNA, 644 bp, Homo sapiens
agggaccggagcaccccaggatcgaagagggcgcacgggcccggccctcccacgcgccctccagggacccggcagccagacagacggacaggcggaccgctagggagctcaagtacccggacacacgcacgagcgcagaacaaagggccggacatgctccagcccgctccgcctgcgcctcggccttgcgcgcgggggcccgggttacctgcgcagtgcccttggtgtggtggaagcaaggtgccatgtgataagtaagcctccagagaggcctgcatggcaggatccaatgtctttagccaacagcatctgggaacctgagacctgccaacacccttgtgagtgagcctggaagtggacctcctgctcttgaaccttgaggtgactatagtgctggctgacaccttgactgcagtccctgagctggggggcccagctgatctactcccagaatcccccctactaaaacagtgatataataaatgcttattgtttcaaaaaaaaaaaaaaaaaaacaaaaaaaaaaaaataaaaacacacaaaataaaacgaaaaacacacaacacaacgggcggggcgcacaaaagaaaccccgggggggccaccgcgcgccccccgcgcgcagagacaaaggcgccccaaga

SEQ ID NO: 276772 - DNA, 557 bp, Homo sapiens
gcctactgcgactactactactaaattcgcggccggtcgaccgagagagatagcacctgaagaaaatgaggccctggaggatgagagactctaaaggaaaagggaagggcctgctgtcttccagccacgccagcccccaactgagaagctgggctggagtgctgtggcacaaccatagctcactgcagcctccacctccctggttcaagcgatcttcccacctcagcctcccgagtagttgagaccacagtgcccttggtgtggtggaagcaaggtgccatgtgataagtaagcctccagagaggcctgcatggcaggatccaatgtctttagccaacagcatctgggaacctgagacctgccaacacccttgtgagtgagcctggaagtggacctcctgctcttgaaccttgaggtgactatagtgctggctgacaccttgactgcagtccctgagctggggggcccagctgatctactcccagaatcccccctactaaaacagtgatataataaatgcttattgtttcaagctggtaacttttggaatgcattca

SEQ ID NO: 276773 - DNA, 422 bp, Homo sapiens
tctccttgagtgtagttggacctagcgacttgcttctaatggatagaatcaagcaaaagtcataggatgtcacttcctggatttggttacaaagactgtaactttctctctttgtctctctctctctctctctcttttagtgcccttggtgtggtggaagcaaggtgccatgtgataagtaagcctccagagaggcctgcatggcaggatccaatgtctttagccaacagcatctgggaacctgagacctgccaacacccttgtgagtgagcctggaagtggacctcctgctcttgaaccttgaggtgactatagtgctggctgacaccttgactgcagtccctgagctggggggcccagctgatctactcccagaatcccccctactaaaacagtgatataataaatgcttattgtttcaa

SEQ ID NO: 276774 - DNA, 642 bp, Homo sapiens
agggaccggagcaccccaggatcgaagagggcgcacgggcccggccctcccacgcgccctccagggacccggcagccagacagacggacaggcggaccgctagggagctcaagtacccggacacacgcacgagcgcagaacaaagggccggacatgctccagcccgctccgcctgcgcctcggccttgcgcgcgggggcccgggttacctgcgcagagccagctgtgatgtaaagaagtttgtgctgcatgagagagatagcacctgaagaaaatgaggccctggaggatgagagactctaaaggaaaagggaagggcctgctgtcttccagccacgccagcccccaactgagaagctggtgcccttggtgtggtggaagcaaggtgccatgtgataagtaagcctccagagaggcctgcatggcaggatccaatgtctttagccaacagcatctgggaacctgagacctgccaacacccttgtgagtgagcctggaagtggacctcctgctcttgaaccttgaggtgactatagtgctggctgacaccttgactgcagtccctgagctggggggcccagctgatctactcccagaatcccccctactaaaacagtgatataataaatgcttattgtttcaa

SEQ ID NO: 276775 - DNA, 564 bp, Homo sapiens
agggaccggagcaccccaggatcgaagagggcgcacgggcccggccctcccacgcgccctccagggacccggcagccagacagacggacaggcggaccgctagggagctcaagtacccggacacacgcacgagcgcagaacaaagggccggacatgctccagcccgctccgcctgcgcctcggccttgcgcgcgggggcccgggttacctgcgcagagccagctgtgatgtaaagaagtttgtgctgcatgagagagatagcacctgaagaaaatgaggccctggaggatgagagactctaaaggaaaagggaagggcctgctgtcttccagccacgccagcccccaactgagaagctgggtgaagccatcttgcatctttagccccagtcaagttacctcagcaaagactagctgaccctgccaagccctgcccaagttacagaatcatgagcaaataaatggctgtttctgttttaagcttttaaattttgggggtggtttatgtgtcaataataactgaaacagataatatatacagaataaactttagttttaataatct

SEQ ID NO: 276776 - DNA, 2845 bp, Homo sapiens
ctttctcctccctcttggggctcaaattgggtgccctggtgaaggaggggggcacactccagaacctagtccaaccccagacgctgcctgaggcttccctccagctcccctcccttccttttctccctttcctccctccctctctttccctttctccctccccgctaaggctggcgtgccagggggtgggacatgccaatcactggctgtgcctctcccgctgccagcacagggcgcagctccccctgggagccaggtgtttgggtccctggagacgccgcaggcccccagggaggcagtggggctgaggaccctacagacccctcttcagccccgtggtgatgactttcccctgaggaagccctgtagcgtgcctggaggaaggggctctccaaccccagccccacctagccaccatgaacacttcagccccacctgctgtcagccccaacatcaccgtcctggcaccaggaaagggtccctggcaagtggccttcattgggatcaccacgggcctcctgtcgctagccacagtgacaggcaacctgctggtactcatctctttcaaggtcaacacggagctcaagacagtcaataactacttcctgctgagcctggcctgtgctgacctcatcatcggtaccttctccatgaacctctataccacgtacctgctcatgggccactgggctctgggcacgctggcttgtgacctctggctggccctggactatgtggccagcaatgcctccgtcatgaatctgctgctcatcagctttgaccgctacttctccgtgactcggcccctgagctaccgtgccaagcgcacaccccgccgggcagctctgatgatcggcctggcctggctggtttcctttgtgctctgggccccagccatcctcttctggcagtacctggtaggggagcggacagtgctagctgggcagtgctacatccagttcctctcccagcccatcatcacctttggcacagccatggctgccttctacctccctgtcacagtcatgtgcacgctctactggcgcatctaccgggagacagagaaccgagcacgggagctggcagcccttcagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatagtcccctctcctgcatccctccaccccagtccccgggaaaggccggtgggaagagggcaggggctgcatcctcagccccagggccctgctcaggcctcacctggcttcccaggaccctgggtcaccttcctgggcagcccagagagaccctgccaactttccagacttcgctattcccaggcagggagggaaacccggggaactggtttttctgttccctgctgggtgggaatgcgctcttcaccaggaagaaggcccgggaggaggatccgggctttggactccttgtttgcctttaggcaggaagtcaggagccagcagggcgggccaggagaaagaaggcttaacattaagtattccttggcccagcagcggcccagattgcggtgtgagatggtgccccctggggggcacagccagaaactgaactggccgctgggagaaaagccagatgacagggagctggggaatcccctcgcttcataggcagagcccgcccacctgggccctaggcatactctccaggattgtccacaaatgtcctcagagggtccctaggtgggtcaactccaaggcaaatgtccaagcatcagcaagacaatgacactggaagggtccggcttggctagtcacatatcaagtcccgaggcagcaacaggaccaggagccaggtgtcctgactgtcctacaatatcattttcctgggagtgggagtcaagtgtgcctgctatccagccgcaaatccataccccctgccccagagaagcctcagtccctccctcctggctcacagccaccacctggatggatctgctccatgcagatctagccaggcctcccgcatgctgcctgcctccggccctgccccacacaggcctggcccagccagcaggttctctcctgtgagctccccaatccaacccatgcatggcctcccagccacccggatctccaggcccagcctggccccaaatgttctttcctttcatcctcagcaagtgctgagtctgtgaataaagccacataaccagcgggccactaagg

SEQ ID NO: 276777 - DNA, 2070 bp, Homo sapiens
ctttctcctccctcttggggctcaaattgggtgccctggtgaaggaggggggcacactccagaacctagtccaaccccagacgctgcctgaggcttccctccagctcccctcccttccttttctccctttcctccctccctctctttccctttctccctccccgctaaggctggcgtgccagggggtgggacatgccaatcactggctgtgcctctcccgctgccagcacagggcgcagctccccctgggagccaggtgtttgggtccctggagacgccgcaggcccccagggaggcagtggggctgaggaccctacagggctccgagacgccaggcaaagggggtggcagcagcagcagctcagagaggtctcagccaggggctgagggctcaccagagactcctccaggccgctgctgtcgctgctgccgggcccccaggctgctgcaggcctacagctggaaggaagaagaggaagaggacgaaggctccatggagtccctcacatcctcagagggagaggagcctggctccgaagtggtgatcaagatgccaatggtggaccccgaggcacaggcccccaccaagcagcccccacggagctccccaaatacagtcaagaggccgactaagaaagggcgtgatcgagctggcaagggccagaagccccgtggaaaggagcagctggccaagcggaagaccttctcgctggtcaaggagaagaaggcggctcggaccctgagtgccatcctcctggccttcatcctcacctggacaccgtacaacatcatggtgctggtgtccaccttctgcaaggactgtgttcccgagaccctgtgggagctgggctactggctgtgctacgtcaacagcaccatcaaccccatgtgctacgcactctgcaacaaagccttccgggacacctttcgcctgctgctgctttgccgctgggacaagagacgctggcgcaagatccccaagcgccctggctccgtgcaccgcactccctcccgccaatgctgatagtcccctctcctgcatccctccaccccagtccccgggaaaggccggtgggaagagggcaggggctgcatcctcagccccagggccctgctcaggcctcacctggcttcccaggaccctgggtcaccttcctgggcagcccagagagaccctgccaactttccagacttcgctattcccaggcagggagggaaacccggggaactggtttttctgttccctgctgggtgggaatgcgctcttcaccaggaagaaggcccgggaggaggatccgggctttggactccttgtttgcctttaggcaggaagtcaggagccagcagggcgggccaggagaaagaaggcttaacattaagtattccttggcccagcagcggcccagattgcggtgtgagatggtgccccctggggggcacagccagaaactgaactggccgctgggagaaaagccagatgacagggagctggggaatcccctcgcttcataggcagagcccgcccacctgggccctaggcatactctccaggattgtccacaaatgtcctcagagggtccctaggtgggtcaactccaaggcaaatgtccaagcatcagcaagacaatgacactggaagggtccggcttggctagtcacatatcaagtcccgaggcagcaacaggaccaggagccaggtgtcctgactgtcctacaatatcattttcctgggagtgggagtcaagtgtgcctgctatccagccgcaaatccataccccctgccccagagaagcctcagtccctccctcctggctcacagccaccacctggatggatctgctccatgcagatctagccaggcctcccgcatgctgcctgcctccggccctgccccacacaggcctggcccagccagcaggttctctcctgtgagctccccaatccaacccatgcatggcctcccagccacccggatctccaggcccagcctggccccaaatgttctttcctttcatcctcagcaagtgctgagtctgtgaataaagccacataaccagcgggccactaagg

SEQ ID NO: 276778 - DNA, 434 bp, Homo sapiens
gggccagaggtgcgtgtgcaacaaaattatgaagggaaacttctttgtcaatacttcacaaatgttttttgcaaggacatcatctcacgtttttccttccttttgtgtttaatccttatttacctaaacagtattaaaacttccccgtttcaacctttttctgcatatataaccacaaattcctttttctttcctctttgactcgtactctactcacgttattcaaagtggctggtctgcaaactatttttataggtccataaggagataggaagcttactccagaatctgtctgctcaacgcttctttcatcaagaaagtcttccccaaaacatcagctgaactgcagtttgcttagtgatagagctgatttacattctgatgtaagcttcttgttgtggatcagttatagttgtggactggcactggcccat

SEQ ID NO: 276779 - DNA, 4398 bp, Homo sapiens
  misc_feature (7)..(7): n is a, c, g, or t
  misc_feature (10)..(10): n is a, c, g, or t
gcggccncgnggcgcgctcctcgccgggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggccgcagcgcccccagcgcccgccttcccgccccagctgccgccgcacgtagctacagaaattgacagaagaaagaagagaccattggaaaatgatgggcctgttaaaaagaaagtaaagaaagtccaacaaaaggaaggaggaagtgatctgggaatgtctggcaactctgagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattaaaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtgggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacggagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcacagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctat

SEQ ID NO: 276780 - DNA, 4340 bp, Homo sapiens
  misc_feature (7)..(7): n is a, c, g, or t
  misc_feature (10)..(10): n is a, c, g, or t
gcggccncgnggcgcgctcctcgccgggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggccgcagcgcccccagcgcccgccttcccgccccagctgccgccgcacgtagctacagaaattgacagaagaaagaagagaccattggaaaatgatgggcctgttaaaaagaaagtaaagaaagtccaacaaaaggaaggaggaagtgatctgggaatgtctggcaactctgagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattaaaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtgggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacggagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcacagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctat

SEQ ID NO: 276781 - DNA, 3268 bp, Homo sapiens
cagttacagagttttatgcaaaagatacagttgacatcaaaggttctcaaattatttctggcattgttaacttagagaagcctgtgatttgctctttggctgccatcataaaatacctcaaagaattcaacttggaatagatgctctccaaacctgacaattttaaacagctatcaagtaaaactggaatttatgacagttaatggaacaacattaaggaatctggaaatcctacagaatcagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacggagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcacagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctat

SEQ ID NO: 276782 - DNA, 1760 bp, Homo sapiens
tatacggctaggtacgaggctgggtgtgcgccaaatatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacggagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcacagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctat

SEQ ID NO: 276783 - DNA, 499 bp, Homo sapiens
ctccaggtacaaataagcacacaccaccagcctctagcagagtttgaaggaggaggaggtcaggttctcccctctggggctggcaggggtaaggattttaggagaaggcacaaaggtaatagtggcaattggtaacctgggtcccttgattatagtagcagctctgaaagctcctttcactggaagggtgacactgacacagcttcctaactatagagcctgcccggtattcaagtgttatagacttttcatagcttctgatgagacgtattgtctcccagcaatttcatttattaaataagtagtatttgatttttccccagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactc

SEQ ID NO: 276784 - DNA, 4399 bp, Homo sapiens
  misc_feature (7)..(7): n is a, c, g, or t
  misc_feature (10)..(10): n is a, c, g, or t
gcggccncgnggcgcgctcctcgccgggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggccgcagcgcccccagcgcccgccttcccgccccagctgccgccgcacgtagctacagaaattgacagaagaaagaagagaccattggaaaatgatgggcctgttaaaaagaaagtaaagaaagtccaacaaaaggaaggaggaagtgatctgggaatgtctggcaactctgagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattaaaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtgggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacggagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcacagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaagaaaaaagaaaagaaatagaattatcaagcttttaaaaactagagcacagaaggaataaggtcatgaaatttaaaaggttaaatattgtcataggattaaatatttattacttgaatgaatgacaaataatttcatccaacaatctttaaactgcttaatcctagtcgacgcgg

SEQ ID NO: 276785 - DNA, 4431 bp, Homo sapiens
  misc_feature (7)..(7): n is a, c, g, or t
  misc_feature (10)..(10): n is a, c, g, or t
gcggccncgnggcgcgctcctcgccgggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggccgcagcgccgcagcggccgcagcgcccgcaggcccccagcgccccagcgcccgccttcccgccccagctgccgccgcacgtagctacagaaattgacagaagaaagaagagaccattggaaaatgatgggcctgttaaaaagaaagtaaagaaagtccaacaaaaggaaggaggaagtgatctgggaatgtctggcaactctgagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattaaaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtgggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacggagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcacagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctat

SEQ ID NO: 276786 - DNA, 3158 bp, Homo sapiens
ggcattgaatacagcagaaataacactgacaaaagttcccatcctcatggatcctagtgagcagagccatttcacaccaggtgatcggggaaagtttcactgagatgatgacttgaatggagacctgaggaagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacggagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcacagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctat

SEQ ID NO: 276787 - DNA, 2206 bp, Homo sapiens
gccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagagaatactcggtggagcaggcgcagcaggtgcttcaccagtcagtgtccatgtccacggtgtcagcccacccttttcgggaccttcccctcggcagggagcaacactgcaagttgcttccaggcgtggctgacatccgggccagccaagtggcacgttggactgtggatgaggtggctgagtttgtacagtctcttctgggctgtgaagagcatgccaagtgctttaagaaagagcagatcgatggcaaagccttcctgcttctgacacagacggacattgtcaaagtgatgaagatcaaactgggcccagcactgaagatttacaactctatcctgatgttcaggcattcccaggaactccctgaagaagatattgcctcaggccaagaagtcaggggatgaatgggctccctgaacttcctctggcaccaagacctgcgctctttcagcaataaaagtggagcacattaatttgatgtgaatgtccccatggccgtatccacattgaatctggactttttaaagtgtctgtgatttgtttacatgtttagaggattttgatgactggtccagtgccaatgactcagaggcttaggcccatctgtgggtttggtttacgaacattgttatctttggtgggatccgctcagctctgatttgtttgcaagacagaccaaagaagcccacatatccacctttattcttctccatcaccagaaaagaaaccattttccatcttacaagcataacactctcaagtggtgaaatattagaaaagcagtgttcatgaatacatcgttaatgtttttaccagagcaacatcgagcttggctcagatctgccatggagcacagctagtctaagagctagaggcctggtgctttcaaaagacttcatgtgagatttttgtgtactttactcaggaaagtgtgaatctctaaaaaataataataataagcacatgttttcatgattcattaattctcctttttgttccattaaccatttcttggttgtgctcccaagctttcctggagcctccacaaaggagagtagccaggagtaatgagaggacggtcaggtgggcacttccaaaagctggagagacccttctgaggaccctccaccatcagcggggcctcaggggaccctgtcctaacactggtgtggctgctgggccagacgctcacctgcacagaactcctccctgctcccactctgaagggcgtttcagaattgactcatttccactgcagtctgccagaacccctgtaataaggagctgtgttatattacatctggggctgtgtgcatctttacaaatggagacacactattcaaagggaagatctctaaagtagggagcgtggtacttattctttgtttgaaacattccgatttgttgtcaggccttatttgttttttgtaagtgattgtatcggaggcttaagttgtgtggaatcagtcccacagtgttgaaagacaagtacctcttttctgacacttcttactacttttacaggtagtaacagctacaaatactctcccagaagtggagggacaccatttgtgggtggggagaaagagggagaggttctatgtccacttgcttcattaagaatgttaaggtttaagaaagttgattctgcttggagaatttctcaagctttacatttttttttcactgaagaaaataaacaaactctaagaggtgtgcatatataacatttctttagatctttacctaaaaggaattttaatatattattggttgatgtaaattttgtttctgtggagttttgtttgttttgctttttgtagactgccatgtgcaagtaaaattcctgcttctgccatgttaaaattttaatatattttaaatgataataaacagagaaaacaaaatttatacctcactaccttaa

SEQ ID NO: 276788 - DNA, 945 bp, Homo sapiens
  misc_feature (92)..(92): n is a, c, g, or t
cagaagctttctagcaacatgcgtctggtgcgcggttgcagtaagtaagtgatcttggtcatagctgaatctaaggatatcctggtcttgancagtgcttggattctcaccatataaatgacgtccgtcaggtaccgagctgtctgaactatacagatggagtctgtagtcatgacgtgtatctcatcagcgaagagtccactcataacctcgagatcatgttatacctccgccccctgtaaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacacttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataagaaaaaaaaa

SEQ ID NO: 276789 - DNA, 286 bp, Homo sapiens
atccatttacagcatggtttactgaatattttgagtagatgctcaatgcagaagcactatggttacgtttgtcagtacgccagtttgcatgaattcaaaatgaatctgaaaagctttccccctcccacttttctttcagtttgtatacaagaacactttacctgagatataggccaaaagtgaaggtaagtccacttcctaggtcctgtgtgtgtgttgggggtatggtactgggagtataggatggaggtggaagaagaaaggggagtttggagaggtagtggag

SEQ ID NO: 276790 - DNA, 5779 bp, Homo sapiens
  misc_feature (1852)..(1852): n is a, c, g, or t
ggccgggccgggggcgcgagcgagcgcgcgggcctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcaattcagagtgttagagacggtctggaaaaacggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccaatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtncccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctacttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctatagcaaattatattttagaaaatactttgtgaggccgggcatggtggcagagcgagactccgtctcaaaaaaaaaggaaaagaaaagaaaatataaggatgtaaaagaagcaatttgcttgcacatctgaatatccttcttgtgtctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttgggcttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtagtcccagcactttgggaggccgaggtgagcagatcacaaggtcaggagatcgagaccatcctggctaacacagtgaaaccccgtctctactggaaatacagaaaaattagtcgggcatggtgctgggactacaggcacatgccaccatgccaccatgcctggctgatttttgtatttttagtagagctgggttggccaggctggtcttgaactcctgacctcaagtgattcacctgccttggcctcccaaagtcctggaattacaggcgtgagctaccgtgcccagctggtttttacattttaaaaacgtttagagaaagaagaatatgcaacagaaactgtatgtagcctgcaaagcctaaaatgtttactctctggcttgggagtttgtctcccctgctctagactgtcagcaagtggtacagtggtacagtacagtggtactgcccaactgcacttctctgcaaggtgattctagtgtgcacttgtcagaatgaaaatatgttattcatttaagacatctcatgtctttgaatgtaatcacatgatttgtatttaatatttacatgacctaattattttttcacgtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacacttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataagaaaaaaaaa

SEQ ID NO: 276791 - DNA, 4853 bp, Homo sapiens
  misc_feature (2045)..(2045): n is a, c, g, or t
ggccgggccgggggcgcgagcgagcgcgcgggcctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcaattcagagtgttagagacggtctggaaaaacggtacattgcttcttatttagcactcacagatggagtctcactctgtcgccgaggctgaagtgcagtggcacaatctcggctcactgcaacctccatttcccgggtttacgcgatccttctgcctcagcctcccaagtagctgggactacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccaatattccatcaggagtctcactctgtcaccccggctgaagtgcaatggcacaatctcggctcattggaacctccacctcccaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtncccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctacttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctatagcaaattatattttagaaaatactttgtgaggccgggcatggtggcagagcgagactccgtctcaaaaaaaaaggaaaagaaaagaaaatataaggatgtaaaagaagcaatttgcttgcacatctgaatatccttcttgtgtctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttgggcttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtagtcccagcactttgggaggccgaggtgagcagatcacaaggtcaggagatcgagaccatcctggctaacacagtgaaaccccgtctctactggaaatacagaaaaattagtcgggcatggtggcgggcgcctgtggtcccagctactcgggaggctgaggcaggagaatggcgtgaacctgggaggcagagcttgcagtggagccaagattgtgccactgcactccagcctgggcaacagagcgagactctgtctcaaaaaaaaaaaa

SEQ ID NO: 276792 - DNA, 5816 bp, Homo sapiens
  misc_feature (1889)..(1889): n is a, c, g, or t
ggccgggccgggggcgcgagcgagcgcgcgggcctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctgttccttcctaccatcctccctgaagagcaacctcaaggaatacagtgagtaacctgatcatgattatacctccaatgttcggtgcaattcagagtgttagagacggtctggaaaaacggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccaatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtncccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctacttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctatagcaaattatattttagaaaatactttgtgaggccgggcatggtggcagagcgagactccgtctcaaaaaaaaaggaaaagaaaagaaaatataaggatgtaaaagaagcaatttgcttgcacatctgaatatccttcttgtgtctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttgggcttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtagtcccagcactttgggaggccgaggtgagcagatcacaaggtcaggagatcgagaccatcctggctaacacagtgaaaccccgtctctactggaaatacagaaaaattagtcgggcatggtgctgggactacaggcacatgccaccatgccaccatgcctggctgatttttgtatttttagtagagctgggttggccaggctggtcttgaactcctgacctcaagtgattcacctgccttggcctcccaaagtcctggaattacaggcgtgagctaccgtgcccagctggtttttacattttaaaaacgtttagagaaagaagaatatgcaacagaaactgtatgtagcctgcaaagcctaaaatgtttactctctggcttgggagtttgtctcccctgctctagactgtcagcaagtggtacagtggtacagtacagtggtactgcccaactgcacttctctgcaaggtgattctagtgtgcacttgtcagaatgaaaatatgttattcatttaagacatctcatgtctttgaatgtaatcacatgatttgtatttaatatttacatgacctaattattttttcacgtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacacttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataagaaaaaaaaa

SEQ ID NO: 276793 - DNA, 5627 bp, Homo sapiens
  misc_feature (1700)..(1700): n is a, c, g, or t
tgtactcagagcagattatttactggctgggggtctgagctaaggattcaaaacaatacaaaatgaggttgcgatgaaagggaactaagacatcatctaacctactgggtttcaaacttttatgaccttaacccacattaaacggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccaatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtncccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctacttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctatagcaaattatattttagaaaatactttgtgaggccgggcatggtggcagagcgagactccgtctcaaaaaaaaaggaaaagaaaagaaaatataaggatgtaaaagaagcaatttgcttgcacatctgaatatccttcttgtgtctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttgggcttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtagtcccagcactttgggaggccgaggtgagcagatcacaaggtcaggagatcgagaccatcctggctaacacagtgaaaccccgtctctactggaaatacagaaaaattagtcgggcatggtgctgggactacaggcacatgccaccatgccaccatgcctggctgatttttgtatttttagtagagctgggttggccaggctggtcttgaactcctgacctcaagtgattcacctgccttggcctcccaaagtcctggaattacaggcgtgagctaccgtgcccagctggtttttacattttaaaaacgtttagagaaagaagaatatgcaacagaaactgtatgtagcctgcaaagcctaaaatgtttactctctggcttgggagtttgtctcccctgctctagactgtcagcaagtggtacagtggtacagtacagtggtactgcccaactgcacttctctgcaaggtgattctagtgtgcacttgtcagaatgaaaatatgttattcatttaagacatctcatgtctttgaatgtaatcacatgatttgtatttaatatttacatgacctaattattttttcacgtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacacttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataagaaaaaaaaa

SEQ ID NO: 276794 - DNA, 5825 bp, Homo sapiens
  misc_feature (1898)..(1898): n is a, c, g, or t
ggccgggccgggggcgcgagcgagcgcgcgggcctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcaattcagagtgttagagacggtctggaaaaacggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccaatattccatcaggtcatgtatggaatgttggtctttacattagtacttcgatctatttatattgttacatgaagagtattgctttgaactgcccctgagagctgaagattggccatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtncccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctacttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctatagcaaattatattttagaaaatactttgtgaggccgggcatggtggcagagcgagactccgtctcaaaaaaaaaggaaaagaaaagaaaatataaggatgtaaaagaagcaatttgcttgcacatctgaatatccttcttgtgtctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttgggcttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtagtcccagcactttgggaggccgaggtgagcagatcacaaggtcaggagatcgagaccatcctggctaacacagtgaaaccccgtctctactggaaatacagaaaaattagtcgggcatggtgctgggactacaggcacatgccaccatgccaccatgcctggctgatttttgtatttttagtagagctgggttggccaggctggtcttgaactcctgacctcaagtgattcacctgccttggcctcccaaagtcctggaattacaggcgtgagctaccgtgcccagctggtttttacattttaaaaacgtttagagaaagaagaatatgcaacagaaactgtatgtagcctgcaaagcctaaaatgtttactctctggcttgggagtttgtctcccctgctctagactgtcagcaagtggtacagtggtacagtacagtggtactgcccaactgcacttctctgcaaggtgattctagtgtgcacttgtcagaatgaaaatatgttattcatttaagacatctcatgtctttgaatgtaatcacatgatttgtatttaatatttacatgacctaattattttttcacgtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacacttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataagaaaaaaaaa

SEQ ID NO: 276795 - DNA, 4912 bp, Homo sapiens
  misc_feature (985)..(985): n is a, c, g, or t
cagctgagtgctggctcacagctaactatctggatatggggttttgttggctcttagctgactgcattatttaatcaaatattaagaaaggtataattcacatgcaacccttggcaaaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtncccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctacttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctatagcaaattatattttagaaaatactttgtgaggccgggcatggtggcagagcgagactccgtctcaaaaaaaaaggaaaagaaaagaaaatataaggatgtaaaagaagcaatttgcttgcacatctgaatatccttcttgtgtctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttgggcttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtagtcccagcactttgggaggccgaggtgagcagatcacaaggtcaggagatcgagaccatcctggctaacacagtgaaaccccgtctctactggaaatacagaaaaattagtcgggcatggtgctgggactacaggcacatgccaccatgccaccatgcctggctgatttttgtatttttagtagagctgggttggccaggctggtcttgaactcctgacctcaagtgattcacctgccttggcctcccaaagtcctggaattacaggcgtgagctaccgtgcccagctggtttttacattttaaaaacgtttagagaaagaagaatatgcaacagaaactgtatgtagcctgcaaagcctaaaatgtttactctctggcttgggagtttgtctcccctgctctagactgtcagcaagtggtacagtggtacagtacagtggtactgcccaactgcacttctctgcaaggtgattctagtgtgcacttgtcagaatgaaaatatgttattcatttaagacatctcatgtctttgaatgtaatcacatgatttgtatttaatatttacatgacctaattattttttcacgtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacacttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataagaaaaaaaaa

SEQ ID NO: 276796 - DNA, 1044 bp, Homo sapiens
  misc_feature (11)..(11): n is a, c, g, or t
gctagaggatnccaaacgacccgaagactctctggcttgggagtttgtctcccctgctctagactgtcagcaagtggtacagtggtacagtacagtggtactgcccaactgcacttctctgcaaggtgattctagtgtgcacttgtcagaatgaaaatatgttattcatttaagacatctcatgtctttgaatgtaatcacatgatttgtatttaatatttacatgacctaattattttttcacgtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacacttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataagaaaaaaaaa

SEQ ID NO: 276797 - DNA, 1161 bp, Homo sapiens
ggccgggccgggggcgcgagcgagcgcgcgggcctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcaattcagagtgttagagacggtctggaaaaacggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccaatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatga

SEQ ID NO: 276798 - DNA, 436 bp, Homo sapiens
atgtgcagttcacaatagtgtttgcgctcctatgagaatctaatgccactgctgatttgataagaggcagagctcaggcgataatgctcacttgcctgcagctcacctcctgctgtgcagcccagttcctaaaaggctgcagacctgtaccagtctgggggatggggacccctgtgttaaggtacagaagtgtgaattggtaactcttgcacatgaaacaggagtacaagttcacccagggatttgtggtagtgtgctgaagcgtttacagaatcagtgactgcatctgaacattcctattttcctataacatttattttattcaactatattgtagggattaaactttctttttttttttttgataaggagtctcactctgtcaccccggctgaagtgcaatggcacaatctcggctcattggaacctccacctc

SEQ ID NO: 276799 - DNA, 214 bp, Homo sapiens
tcccgccctgctacctggataaccaaagacattcattttaccccacagaagagtattgctttgaactgcccctgagagctgaagattggccatggtaagtaagtttagaagcagaaaacagatagcaccctacccccactgatcatattcctgtcatatttcagtacctggcccacactgccagaagccttcactgtgttgaggcctatgtttc

SEQ ID NO: 276800 - DNA, 5972 bp, Homo sapiens
  misc_feature (2045)..(2045): n is a, c, g, or t
ggccgggccgggggcgcgagcgagcgcgcgggcctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcaattcagagtgttagagacggtctggaaaaacggtacattgcttcttatttagcactcacagatggagtctcactctgtcgccgaggctgaagtgcagtggcacaatctcggctcactgcaacctccatttcccgggtttacgcgatccttctgcctcagcctcccaagtagctgggactacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccaatattccatcaggagtctcactctgtcaccccggctgaagtgcaatggcacaatctcggctcattggaacctccacctcccaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtncccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctacttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctatagcaaattatattttagaaaatactttgtgaggccgggcatggtggcagagcgagactccgtctcaaaaaaaaaggaaaagaaaagaaaatataaggatgtaaaagaagcaatttgcttgcacatctgaatatccttcttgtgtctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttgggcttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtagtcccagcactttgggaggccgaggtgagcagatcacaaggtcaggagatcgagaccatcctggctaacacagtgaaaccccgtctctactggaaatacagaaaaattagtcgggcatggtgctgggactacaggcacatgccaccatgccaccatgcctggctgatttttgtatttttagtagagctgggttggccaggctggtcttgaactcctgacctcaagtgattcacctgccttggcctcccaaagtcctggaattacaggcgtgagctaccgtgcccagctggtttttacattttaaaaacgtttagagaaagaagaatatgcaacagaaactgtatgtagcctgcaaagcctaaaatgtttactctctggcttgggagtttgtctcccctgctctagactgtcagcaagtggtacagtggtacagtacagtggtactgcccaactgcacttctctgcaaggtgattctagtgtgcacttgtcagaatgaaaatatgttattcatttaagacatctcatgtctttgaatgtaatcacatgatttgtatttaatatttacatgacctaattattttttcacgtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacacttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataagaaaaaaaaa

SEQ ID NO: 276801 - DNA, 5850 bp, Homo sapiens
  misc_feature (1923)..(1923): n is a, c, g, or t
ggccgggccgggggcgcgagcgagcgcgcgggcctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcaattcagagtgttagagacggtctggaaaaacggtacattgcttcttatttagcactcacagaagtacttcagatttgagaaaagagcacataactatggctaaaagatgggatttgtaatctctggagttttttacttcaagtctgaggatccaaactgactaagtgaagtaaagaaataagcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccaatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgatgtgtgtgtatgcctcaaatgcagaaacagttgggcttttcttaacaggttaacagtttgtgctggttataagaaattaaccttcttttctttttgccaagggttgcatgtgaattatacctttcttaatatttgattaaataatgcagtcagctaagagccaacaaaaccccatatccagatagttagctgtgagccagcactcagctgtgtcagatttgattaatattgtattaatctcatggatggttctcaaaggtaaaaaaagagagagaaagagagagagctagctgtgggattctgtgtagttcttcactatctgttccagggctagtcggaggatcataagcaagctcagacctgcccccagttcagtacttgaccacatcccaggatttatggtgtctgtctatggccacagccaaccagaatgagtgggtcatcttataacctttctgaagctccatgaggacatgtatagaatgctgcaccttcagccagctctgctctgatctttgcagatctttaagttgtcactgtttctacggctagacaaatatgactggtggtctagactacccatagttcatcctcctcacataacttatttgaagttgtcagggaatgtcattacactctgatttttaaaattatgcagtattttccagttctcagagaggtcatggttgtncccagggaagtgtgttgcattaactaaagctaaaattatcagaatcctatttacataaagcatattaaaatatctgctccttaattttctgaaggaaatagatgtaagtttctgctacttgaaacctacagaaccgacaaaaattagggtgctaaaaaaatgacagtgaaatctcatcgtaaggcagctagttctaatttgcatttgaatgtataacaaattgcatcacttttcacaaacttaacacctgcctggagtaaaaatctgatttgacccctctgctcatgtttcatcatatttgtagctctgcatcatttagcatttttatgactttttttgctttatataaattattgtaaaatccagattgtttttaccacatgatgacgtgactcaggattaaatcctgagctacagtttcaaaaggaaaatcatttttttcttatgcaaagatggtaaaacactgttgtcattttttccagtattcaataagtagcctttgtacaaatttaaaaccaaaaactattctgttgtttttcttcacctactagccttagtttttaaccaagtatccaaggatgtcaacttgacatccttcccttagcatgccaacaagccattagactgattcttccacctacttttatgaacctccaggaagaaaaacacttgccaaaacattaagagaactttgattctgccttaagagggtataaaactaaaccatttgaaggcacagcccataagactatacttgattttgccccaagattctgacttctggctacatttcacctgcagttacctgggctatcggccgtgatacattttttaattcatttgttttccaccattatatttttatacttttcagttagatatacttctgcataaagagtatatatacagtgtaggataaaggcatatcgtacatggcaatgctgttaaacatggtaagactgaggttctgcaggattaaagtcagattaagggtacagaaagcacaccttgatactgaggccatttagagcaatttgtttaatgagtggttcagccatcaccaccagtggccacctgttcaataaaattgcctagcaccacagtggagagtcatctacaccccaaggtgagctgtaagactggccaattctttgaagacctttttttctgttgggagaatggaaagcagaaagggaagccaggctctttaatgttccaagtcagctgtgcctcacacaaggctctctttttagctactaagtaacatactcaagactttgtatctgtgcagcattttatggaaatcactggtgacctataggatattactaaattatttcaatagctttatttttttcctacttggattctaggtggacattacagagttgaattcctcactaccccctcccgctgtcatttgttttattggaaaacttcatgttaactagagtgtacaaaaagtctgtttcctgctgagccaatagtgatttgtttgcatatcacctaatgtgaaaagtgctcatctgtgaactctatagcaaattatattttagaaaatactttgtgaggccgggcatggtggcagagcgagactccgtctcaaaaaaaaaggaaaagaaaagaaaatataaggatgtaaaagaagcaatttgcttgcacatctgaatatccttcttgtgtctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttgggcttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtagtcccagcactttgggaggccgaggtgagcagatcacaaggtcaggagatcgagaccatcctggctaacacagtgaaaccccgtctctactggaaatacagaaaaattagtcgggcatggtgctgggactacaggcacatgccaccatgccaccatgcctggctgatttttgtatttttagtagagctgggttggccaggctggtcttgaactcctgacctcaagtgattcacctgccttggcctcccaaagtcctggaattacaggcgtgagctaccgtgcccagctggtttttacattttaaaaacgtttagagaaagaagaatatgcaacagaaactgtatgtagcctgcaaagcctaaaatgtttactctctggcttgggagtttgtctcccctgctctagactgtcagcaagtggtacagtggtacagtacagtggtactgcccaactgcacttctctgcaaggtgattctagtgtgcacttgtcagaatgaaaatatgttattcatttaagacatctcatgtctttgaatgtaatcacatgatttgtatttaatatttacatgacctaattattttttcacgtcagtttttctagattggcaatagcctgttgcaaagtgcctaaacctttgagaaaaattactatgagcaaggtccatgatttagttttcaatataaagggaattccattctatactgtaaaatccaaaaatgctagttgccctcagcttttgagttgacttccagaaagttgagatcttttgaccattttttctcatgtcatataaaatgtgccacatggtagttgtcaagctgtggtagtcatgtacacttttttcttttttttaactttctaaaaggaaaagttcaaagtcctttccacagttagtcttcgcttcttttggatttttctttttagagctaaattattcataccaatgaataagtgagtctgttctaagatataggggccattatctatttttgcttaatggactcatgtggcattgttcactatcatgcctttccatacttgtaatatttctgagtcacttattaatgtgaccaacagataaactgttcaagctaatacagcatttcctaacttcatagttgtcgcagatgtttgttctagtagcgattatttaataaacatacattgtactgaatcttactagcaactaactattttcaggtaatctcagtctgcttattcactttttccatttgatttgctaatgccacaatcatttttctagaaaatagtaggataatgtattttttcctgtctgctataatggagactatatttctgcattcattacctctcataggtgaaaatattaaattaaataatattgttttgaataagaaaaaaaaa

SEQ ID NO: 276802 - DNA, 454 bp, Homo sapiens
tgacccctctatgtttctctctttccctttttccttctctttccctgtttctctcccttcctttctctttctttctctcttgctctctctgtctcttgcttgctctctctctctttttgttcttagcccctctgaggaaggcaaagtttgttgagagcccacgaattccagaatccgagcttggctcaccaaccctcacttcagctcagaaactggacgtggatgcatactgccctggtgatgctgaacaggagcttggcccccctccatctgtagatgaggcagcaaacacactcatgactcgtctgggtttcctccttggagagaaagtcacagaagttcagccaggtgaccaatacagcatggaagtacaggatgaaaatcagacctcagcaatcacccagcggataagtccttgttccactctgactagcagcactgcctctccaccagc

SEQ ID NO: 276803 - DNA, 755 bp, Homo sapiens
  misc_feature (378)..(378): n is a, c, g, or t
  misc_feature (387)..(387): n is a, c, g, or t
  misc_feature (505)..(505): n is a, c, g, or t
tcagggatctcatacctgccttttaagatgaaatgtattttcatatgaggctttaaattctctgaaaaaagtaatttatgaatcatggtcagatttgaaaatattccatcgatgccatagatcttgagggagagtcagtcactcaatcagaatgcgctatcaggtggtcatggagagaatgtgatgatatgcatctcacttgtagccacttccaaaatctgaaatgtacacccttttatagggagctgtctggtctggtgattattacagcatggattatcctgtgccacagttcctcaaaaatccagttggtagcatcgataaacaccgtgtttatcgatgccacctgtaaatactattttcttttgcaaaataacnaaaaggacnaaaaaactttaaaaattacagtaaaacataaagtagttctcaagtggaaaagttatcattcacaatgtccttgagttgttccttccttaatcaacctttgtcacattctgcttcaccnaacttggtccacttaacagtagtataatttttaagactcattcaacagcttaattatttctactatattctgaggtttgatagaattttctgtactgttgccattgtgactaaggcagaggagatgtgaatgaaaagatattcgtgcacagttagattctgtgcccttcataaatcaagcccgaaggtgtatgttcagtttaaatgatccaaataatggactgattatgaagtggcatcgataacccggg

SEQ ID NO: 276804 - DNA, 852 bp, Homo sapiens
gtgaggaaggtagctttagtgaaaacagggtttggagttgaacctatacgggttcaaattcgacttccgtccaccaccgagacctgcgctccctgagggactcgctttcccatccgcgaaaccaggacggcgccgcctacaccccgcggcgttcggggcgggctgaatgggtcgctgagtgggggctacacccacgcccttcgctccccgcccccgggcggagcgacggccacggcagtgtccccaaggcaccgaaaccgaggcgggggtctcggtccctccgcgcaaggaggaaggcggaccgtacgtggcaggactcaccgccccgcgccgtgttctccgagccatggcgccagcgctgtggcgggcctgcaacggactcatggccgccttcttcgcgctggcggccttggtgcaggtaaatgacccagatgcagaggtgtgggtggtggtgtacacaatccctgcagtactgaccctgcttgttggacttaaccctgaagtcacaggtaatgttatttggaaaagtatctctgcaatacacatactcttttgtacggtgtgggctgttggcttggcgtcctacctcttgcatcgtacacaacagaacatcttacatgaggaagaaggcagggagctgtctggtctggtgattattacagcatggattatcctgtgccacagttcctcaaagaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgttttt

SEQ ID NO: 276805 - DNA, 1532 bp, Homo sapiens
gtgaggaaggtagctttagtgaaaacagggtttggagttgaacctatacgggttcaaattcgacttccgtccaccaccgagacctgcgctccctgagggactcgctttcccatccgcgaaaccaggacggcgccgcctacaccccgcggcgttcggggcgggctgaatgggtcgctgagtgggggctacacccacgcccttcgctccccgcccccgggcggagcgacggccacggcagtgtccccaaggcaccgaaaccgaggcgggggtctcggtccctccgcgcaaggaggaaggcggaccgtacgtggcaggactcaccgccccgcgccgtgttctccgagccatggcgccagcgctgtggcgggcctgcaacggactcatggccgccttcttcgcgctggcggccttggtgcaggtaaatgacccagatgcagaggtgtgggtggtggtgtacacaatccctgcagtactgaccctgcttgttggacttaaccctgaagtcacaggtaatgttatttggaaaagtatctctgcaatacacatactcttttgtacggtgtgggctgttggcttggcgtcctacctcttgcatcgtacacaacagaacatcttacatgaggaagaaggcagggagctgtctggtctggtgattattacagcatggattatcctgtgccacagttcctcaaagaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgttttttacaaatgaatattttcaatcaattttttataaacattaggggaacaagccaggagtttatttcaggtaatttgggctaatagttttaaaactccaaataactttttaagggtgcatataattcgatgtaagattggatgggacaagtaagagatggtctgatattttccagacgactttctgcagggtattgtgtcataatgtagtggaaaaggctagagaatagaagtttaaaaatacgagttctaacttaactttgtaactatgtaatttgggcaaatatataaacctcctggtggatatttatctataaaataggattaatgccagatctacttacttacacagtaacaaggatcaatctagataatgtaagaacactctgaagatataaagtgtttggaaagattacggagggctgcccatgattaaaatagaggggagcagggattgggtaatatactgaaatagacattcaagagagggctataccccgatctttttttttttttaagacagtcccactctattgcccaggctggagtgcagtggcatgatcatggctcactgcagtcctgacctcccggggctcaggtgatcctcctacctcagcctcccaagaagctacgactacaagtgtgcaccaccatgcccggctaaatttttttaaattttttgta

SEQ ID NO: 276806 - DNA, 1140 bp, Homo sapiens
tcagggatctcatacctgccttttaagatgaaatgtattttcatatgaggctttaaattctctgaaaaaagtaatttatgaatcatggtcagatttgaaaatattccatcgatgccatagatcttgagggagagtcagtcactcaatcagaatgcgctatcaggtggtcatggagagaatgtgatgatatgcatctcacttgtagccacttccaaaatctgaaatgtacacccttttatagggagctgtctggtctggtgattattacagcatggattatcctgtgccacagttcctcaaagaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgttttttacaaatgaatattttcaatcaattttttataaacattaggggaacaagccaggagtttatttcaggtaatttgggctaatagttttaaaactccaaataactttttaagggtgcatataattcgatgtaagattggatgggacaagtaagagatggtctgatattttccagacgactttctgcagggtattgtgtcataatgtagtggaaaaggctagagaatagaagtttaaaaatacgagttctaacttaactttgtaactatgtaatttgggcaaatatataaacctcctggtggatatttatctataaaataggattaatgccagatctacttacttacacagtaacaaggatcaatctagataatgtaagaacactctgaagatataaagtgtttggaaagattacggagggctgcccatgattaaaatagaggggagcagggattgggtaatatactgaaatagacattcaagagagggctataccccgatctttttttttttttaagacagtcccactctattgcccaggctggagtgcagtggcatgatcatggctcactgcagtcctgacctcccggggctcaggtgatcctcctacctcagcctcccaagaagctacgactacaagtgtgcaccaccatgcccggctaaatttttttaaattttttgta

SEQ ID NO: 276807 - DNA, 946 bp, Homo sapiens
gtgaggaaggtagctttagtgaaaacagggtttggagttgaacctatacgggttcaaattcgacttccgtccaccaccgagacctgcgctccctgagggactcgctttcccatccgcgaaaccaggacggcgccgcctacaccccgcggcgttcggggcgggctgaatgggtcgctgagtgggggctacacccacgcccttcgctccccgcccccgggcggagcgacggccacggcagtgtccccaaggcaccgaaaccgaggcgggggtctcggtccctccgcgcaaggaggaaggcggaccgtacgtggcaggactcaccgccccgcgccgtgttctccgagccatggcgccagcgctgtggcgggcctgcaacggactcatggccgccttcttcgcgctggcggccttggtgcaggtaaatgacccagatgcagaggtgtgggtggtggtgtacacaatccctgcagtactgaccctgcttgttggacttaaccctgaagtcacaggtaatgttatttggaaaagtatctctgcaatacacatactcttttgtacggtgtgggctgttggcttggcgtcctacctcttgcatcgtacacaacagaacatcttacatgaggaagaaggcagggagctgtctggtctggtgattattacagcatggattatcctgtgccacagttcctcaaaaggcagagtcttgctttgttgcccagactggaaggcagtggcccgatcacagctcactgcagcttcaaactcctaggctccagtgacccactcacctcagcctcccaaagtgatgggattacaggcgtgagccaccacatctggccccaagaactgttttcaatgatagcattttatttaatattataaaattaatatgaagaagttgctactaaaagaagcactttagcaaataaaatttaatagatcaggt

SEQ ID NO: 276808 - DNA, 633 bp, Homo sapiens
cctggaaggggctggttccgcgcgtggaacttcccaggggacctcagaagaagcggccctggctcctgcgttaacgtccggcccgcggacgacactgaacatatctcagggcctaggagacgaagccgaccaaaaccctttatagcatcattaaactttttagtcggcttggggacccccttcataatcatttccctcatttcttgagactggtgggggtggagggcccttaaaatacccgttctgggttggcgagtcctctccagagctcccgtgaaggcttttcaaaaatgtgtggctgcctgttaaaaacatctgttgtgtcagccagaaaccccttcacccgtcctcatctggactatatcctgttcagattttgtaccctcgatgcctattgcagtgtctggcacttaacaaattaataaaaaatgtgcttaaatgaatttaaaaggaatggaacagcacaggatgtctgctaacaccttggtattctggcgttccaggtaaatgacccagatgcagaggtgtgggtggtgagtatgagccgcttccaggctttcctccgtttggaagaattggggaacggcacaaaacacacggttttatgtctttacccctcctccctgcttaatt

SEQ ID NO: 276809 - DNA, 1580 bp, Homo sapiens
gtgaggaaggtagctttagtgaaaacagggtttggagttgaacctatacgggttcaaattcgacttccgtccaccaccgagacctgcgctccctgagggactcgctttcccatccgcgaaaccaggacggcgccgcctacaccccgcggcgttcggggcgggctgaatgggtcgctgagtgggggctacacccacgcccttcgctccccgcccccgggcggagcgacggccacggcagtgtccccaaggcaccgaaaccgaggcgggggtctcggtccctccgcgcaaggaggaaggcggaccgtacgtggcaggactcaccgccccgcgccgtgttctccgagccatggcgccagcgctgtggcgggcctgcaacggactcatggccgccttcttcgcgctggcggccttggtgcaggtaaatgacccagatgcagaggtgtgggtggtggtgtacacaatccctgcagtactgaccctgcttgttggacttaaccctgaagtcacaggtaatgttatttggaaaagtatctctgcaatacacatactcttttgtacggtgtgggctgttggcttggcgtcctacctcttgcatcgtacacaacagaacatcttacatgaggaagaaggcaggttcaagctattcttctgcctcagcctcctgagtagctgggattacagggagctgtctggtctggtgattattacagcatggattatcctgtgccacagttcctcaaagaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgttttttacaaatgaatattttcaatcaattttttataaacattaggggaacaagccaggagtttatttcaggtaatttgggctaatagttttaaaactccaaataactttttaagggtgcatataattcgatgtaagattggatgggacaagtaagagatggtctgatattttccagacgactttctgcagggtattgtgtcataatgtagtggaaaaggctagagaatagaagtttaaaaatacgagttctaacttaactttgtaactatgtaatttgggcaaatatataaacctcctggtggatatttatctataaaataggattaatgccagatctacttacttacacagtaacaaggatcaatctagataatgtaagaacactctgaagatataaagtgtttggaaagattacggagggctgcccatgattaaaatagaggggagcagggattgggtaatatactgaaatagacattcaagagagggctataccccgatctttttttttttttaagacagtcccactctattgcccaggctggagtgcagtggcatgatcatggctcactgcagtcctgacctcccggggctcaggtgatcctcctacctcagcctcccaagaagctacgactacaagtgtgcaccaccatgcccggctaaatttttttaaattttttgta

SEQ ID NO: 276810 - DNA, 481 bp, Homo sapiens
caacatggtgaaaccgtgtctatgcgaaaaatacaaacattagccaggcatggcagctcgggcctgtagtcacagctacttggggtatgaggcaggaggattgcttgagccaggatgcgcaggttgcagtgagtcgagatcacactactgcactccagcctgggtgacagtgaaatcctgtccaaaaaagagaaaaaaaaggccacgcgcggtggctcatgcctgtaatcccagcactttggtaggccaaggcaggtggatcacaaggtcaagagttcgagactagcctggccaacatagtgaaaccctgtttctactaaaaatacaaaaattagccaggtatggtggcacgcacctgtagtcccagctacttgggaggctgaggccggagaattgcttgaacccgggagacagaggttgcagtgagctgagaccacgccattgcactccagcctgggtgacagagtgagactccatctca

SEQ ID NO: 276811 - DNA, 656 bp, Homo sapiens
ttttttgtagatgtgggtcccactgtggcccaagctggtctccaactcctggcctcaagcgatcccccccatttcaacctcccaaagtgctgggattacaggcatgggccaccacgcctggcgtggcttaactgttactatcccatatcacagccataaattccaagctgggaagacagcatgtgtatgtctggtagatgaaaaactggatagcgattaagcagaaccatgtagaggtattccaggctgaaaaaggaatatctaaaatatcgcctctgttccacacgcacatacacatttacaaagacggcagcatcgttccaccctggagccctagctccttggaggtaaagaaaggtggtaaaagaggagtgggaactgagggtaaacctcacaccctgatacagtgatatccgctcccctaaccctaattcctgaggccaaggccctatccacactctaaaatgcagaggaggaacacaccttctgtcttcaaaccagccccacatcacgctaaccctaggccaagggctagtgtgcctacagtcagagggtggccgacctgaggtgagaaagtactttccattaagcagaggacgccacccccaacaccctgcactttcaaggtactcctggtgacttctatccagctcccc

SEQ ID NO: 276812 - DNA, 420 bp, Homo sapiens
ttttttgtagatgtgggtcccactgtggcccaagctggtctccaactcctggcctcaagcgatcccccccatttcaacctcccaaagtgctgggattacaggcatgggccaccacgcctggcgtggcttaactgttactatcccatatcacagccataaattccaagctgggaagacagcatgtgtatgtctggtagatgaaaaactggatagcgattaagcagaaccatgtagaggaggaacacaccttctgtcttcaaaccagccccacatcacgctaaccctaggccaagggctagtgtgcctacagtcagagggtggccgacctgaggtgagaaagtactttccattaagcagaggacgccacccccaacaccctgcactttcaaggtactcctggtgacttctatccagctcccc

SEQ ID NO: 276813 - DNA, 875 bp, Homo sapiens
gcacttatgcacttgtggttgcaactttagcagtttgaggtgcaacagcgaaactagctgagttgctttttttcttcttcatatgaatagaagactcattctgctgtaatcttagcaacctcagcatatgagagagtttttccttattgagtggagaagaaatttcacattttcccattaaggaagcactttgtagcttctttttggcatatctgaattgtcagcatcactattcttgtgctttggggccatgattaagtaaaataagggtcagttgaacacaagcactacgatactgcatcaggtgatctgacagctcctaagtgactaacaggtgggtagcattcgcagcatagatatgccaggacaattcacattcggggtggggtggagcaggatggtgcgagacgtcacactactcagaatggtgtacagtttaaacatgaattatttctggaattttctatttaatacttttaaatattgaacaaaggtaactgaagtggtgaaaaactacagaggagaggactactgtaattcccagccttgttcctttataggtaaggtttttttcctttgacttcttttttctttgtatttgattttctgaaattggaatataatatacctaattgtaggggtttttgtgaggggcgagagggcacttaccttgcttggtgttctctgtgtttcctccatctgtggtttggtttatgacattaatttggggaaattctccgtcattatttcctcaaagactgcttctgttcttccttcttttttagtatttctgttatgcgtatattacatcatttgtagttgtcctacagttcttggataatctgttccttttttttccctcaatattttatctg

SEQ ID NO: 276814 - DNA, 2530 bp, Homo sapiens
ctaaaggtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaatgcatggacaagggatgagctttacaaagatgatgcactttggagatcagaaaattcatatttaagcaaagtgatacaaacacagtgatttgggaatgccttcatttacaatgcaatacttaaattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacat

SEQ ID NO: 276815 - DNA, 3176 bp, Homo sapiens
atggattagccattctttattcctttactttcctaataaacttgctttcaccttatggattcgcctcaaattctttcttgtgcaagatccaagaaccctctcttagagtctgagatccggacccctttccagtagcaaaaggtcttagactgaagtactgactccacagtcgttgttaagaatcctagttgtttaatagaggcggtcttgggctcttgctgggccgcggtgtgttctgggaagtgtagtcacctgagtctccagttccttgtctctgggccgtgtgtgcacgccagcgaagcactgtgggagtcgtagtaggggaggaaaaccctataccctctggcgtgcggcgcaggagtttgggggaatgtagtcgccagagctctgcgttgtcttccggctttgggcgtggccacgatgcactctgggagtcgtagtaggggaagaacgtcctccgctcttttgcgcacggtcgctagaggttctgggaagtgtagttgcctgaagctcgtgttctttgtctttcgatgatgtgcgcttggcctcaaagcaccctgggagttgcagtggggcggggaaagccatatgctctctcgcgcggggtcgcggttgtttctgggaagtgtggtggcctgagttccacgttcttcgtttctccgctagttgtgcgcttggccgcgagacactctggcagttataggaacacaaaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcaggctttttttcagctaactgtgtcagcttctttagctgggcccatgtcgacggctccgctttcttggtagatggaaacttcttttgtaagttgtaactgaagtggtgaaaaactacagaggagaggactactgtaattcccagccttgttcctttatagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaatgcatggacaagggatgagctttacaaagatgatgcactttggagatcagaaaattcatatttaagcaaagtgatacaaacacagtgatttgggaatgccttcatttacaatgcaatacttaaattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacat

SEQ ID NO: 276816 - DNA, 2696 bp, Homo sapiens
gagactgtatgccccatttgaagggtggtgctgttatctgctgtagccaattattaccctgaagaaattctggctgaattatattaaaataggctggtattaaggaaaatatacattgtttattaacataaaggaatactgtaaaatcttaagaatttttacaaccaatgccaaaaatccatattgttcatgtgtataatcctttattttgaataaaattgtaaattatctcaggacagataatttatgtttttctccttttctccagttatacaacaaaacacaagagctaggctcttcattatataattactcagaattctgaaaactctcactgttactacttagacacattgcctaacctccacagtgagactcattttattccttgatgagggagtttgggggcatgcgtgctggtcatgcaaatatctgtccgtcatttcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaatgcatggacaagggatgagctttacaaagatgatgcactttggagatcagaaaattcatatttaagcaaagtgatacaaacacagtgatttgggaatgccttcatttacaatgcaatacttaaattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacat

SEQ ID NO: 276817 - DNA, 2116 bp, Homo sapiens
cttcattctgttgctaaagaagggagaaatggccttattttattcaatacaggaaaaagaaacattcacttttttttttggtatctttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaatgcatggacaagggatgagctttacaaagatgatgcactttggagatcagaaaattcatatttaagcaaagtgatacaaacacagtgatttgggaatgccttcatttacaatgcaatacttaaattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacat

SEQ ID NO: 276818 - DNA, 1691 bp, Homo sapiens
ctaaaggtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagaaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacat

SEQ ID NO: 276819 - DNA, 2420 bp, Homo sapiens
ctaaaggtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaatgcatggacaagggatgagctttacaaagatgatgcactttggagatcagaaaattcatatttaagcaaagtgatacaaacacagtgatttgggaatgccttcatttacaatgcaatacttaaattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttatta

SEQ ID NO: 276820 - DNA, 3018 bp, Homo sapiens
atggattagccattctttattcctttactttcctaataaacttgctttcaccttatggattcgcctcaaattctttcttgtgcaagatccaagaaccctctcttagagtctgagatccggacccctttccagtagcaaaaggtcttagactgaagtactgactccacagtcgttgttaagaatcctagttgtttaatagaggcggtcttgggctcttgctgggccgcggtgtgttctgggaagtgtagtcacctgagtctccagttccttgtctctgggccgtgtgtgcacgccagcgaagcactgtgggagtcgtagtaggggaggaaaaccctataccctctggcgtgcggcgcaggagtttgggggaatgtagtcgccagagctctgcgttgtcttccggctttgggcgtggccacgatgcactctgggagtcgtagtaggggaagaacgtcctccgctcttttgcgcacggtcgctagaggttctgggaagtgtagttgcctgaagctcgtgttctttgtctttcgatgatgtgcgcttggcctcaaagcaccctgggagttgcagtggggcggggaaagccatatgctctctcgcgcggggtcgcggttgtttctgggaagtgtggtggcctgagttccacgttcttcgtttctccgctagttgtgcgcttggccgcgagacactctggcagttataggaacacaaaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaatgcatggacaagggatgagctttacaaagatgatgcactttggagatcagaaaattcatatttaagcaaagtgatacaaacacagtgatttgggaatgccttcatttacaatgcaatacttaaattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacat

SEQ ID NO: 276821 - DNA, 2597 bp, Homo sapiens
ctaaaggtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcaggtaactgaagtggtgaaaaactacagaggagaggactactgtaattcccagccttgttcctttatagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaatgcatggacaagggatgagctttacaaagatgatgcactttggagatcagaaaattcatatttaagcaaagtgatacaaacacagtgatttgggaatgccttcatttacaatgcaatacttaaattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacat

SEQ ID NO: 276822 - DNA, 1776 bp, Homo sapiens
ctaaaggtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagttccgttgaagccgtcgggtaccgagctc

SEQ ID NO: 276823 - DNA, 867 bp, Homo sapiens
acggaacgctatacaggaatcagctatcaccgggaacagctatgacctggaaatcattatgaccaggtaatatggtatcacacggatacagctatccatgcgagaaaaaaatatccaaggagtatgtggaatagccatgaataaccatctataataattaggcaataccaaggtgaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagaaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacat

SEQ ID NO: 276824 - DNA, 307 bp, Homo sapiens
tcagtgtttttcccattgcccttaatgttctccagaaggatcctaagaaagctcccaatctggatctcttaaaggtcctacaaatacacaacataagaagctaaagaggaaattcataaggtccatttgaataccttggaaactactgaaagaataaaggggtcaggaggaaacccagacgagtcatgagtgtgtttgctgcctcatctacagatggaggggggccaagctcctgttcagcatcacctgtaacaagaaggcattgaagaacatgaatctttcaaaataaaatggtctagttctgcaa

SEQ ID NO: 276825 - DNA, 908 bp, Homo sapiens
ccaaagtgaaccaaatgctaatgcacattttattggatgaaaagacaaacaacataattatacttgaatttcagggaatcaaaagtagtacaacagcgtgtgcaccagactccagggcagggttcgtaagttagccatacacatgctcatttttccaagctggggaagtttgctaaaatgagctgagggctacttcaccagactgacaaaaaggaaaatgtctatcagtttttcttttgttctctctagatcctgttcaagtgtacactgagccagcaggttcaccagaaagctattgagcgtttgctggaacacattatgcagggtgaatttcttctggaatgttgccaaggattttttatgcttctgtggcaggcatttcttgaacattgtcatttagccaagcaaagaagattttcttaaaggatagaaaatgtttaaaaatttttgtttgtttgaagataggttaaatggctatatgatctcaggataagacagagaaaatcacttatttctctaagtgatctgattaggttagtgatgttttgcctttaaacagattcatcattattcctaaagtattgctgtattaatactgtcttctagaaagtatccaccagtgcctacttttcttcgatatcattagctgtttttcgaaactgaatttgctcttcagagatttctcatatgtttgcgtataaggaactactggtaatagccaagaaaatttggaggtgcagagaacatgctgaaacagaatttttcactttcaattctagaactatgccataaaaaaaaaggaaaatgtaaaaatgtctttatattagagcagatattttaaaagtattgcaaattcaatgataaattctaaggttaaaattggacacataaaaaatacaatatataaa

SEQ ID NO: 276826 - DNA, 691 bp, Homo sapiens
cgcgcggccgcggcgctacctttctccaaacaacgttgccacacgcggagagcacggagatttctggggctttggagggaatcgtgagcgggcgggaggaggccggggaccacacagagaataacttgtctgactaccagtattcttggatgcagaagtgctgaagatgagcacacacacgtacggagaatttctggagaattcagctgctcagaacaagaactgagatccagagagatgatgactttgcccatagaccaaacaaagaaatacatgtttcagtcctgtgtcctcctgctatgtgtgtccggaattggtgggttcttggtctcactgacttcaagaatgaagctgcggaccctcgcggaccgtgtgtgaatgcctgctctgtgagccctcagaatctactggctgaatgagtgcgtggaggaaatgtgctcagagctgctgtgtgtcatcctgtgtttgaagtgctcctgcagctatcattcatccagttaagaatttgaagaagtgtgtgcacaaaggtgacactttgcttatcctttccccaaaattacagttctaaaattttcctatacaatccttctaaattggatgacagttgtcccattttcctttgcaggatgtaccagactattaatattggtgaccatgggctagggagtatgttcttgataaatttacaaaa

SEQ ID NO: 276827 - DNA, 201 bp, Homo sapiens
cgcgcggccgcggcgctacctttctccaaacaacgttgccacacgcggagagcacggagatttctggggctttggagggaatcgtgagcgggcgggaggaggccggggaccacacaggtgagcccccgcccgcgccctgcccgggacggcggcgggcgctgccagccccgctcccccgcacccggggtccgcacggtgcct

SEQ ID NO: 276828 - DNA, 2132 bp, Homo sapiens
cgcgcggccgcggcgctacctttctccaaacaacgttgccacacgcggagagcacggagatttctggggctttggagggaatcgtgagcgggcgggaggaggccggggaccacacagagaataacttgtctgactaccagtattcttggatgcagaagtgctgaagatgagcacacacacgtacggagaatttctggagaattcagctgctcagaacaagaactgagatccagagagatgatgactttgcccatagaccaaacaaagaaatacatgtttcagtcctgtgtcctcctgctatgtgtgtccggaattggtgggttcttggtctcactgacttcaagaatgaagctgcggaccctcgcggaccgtgtgtgaatgcctgctctgtgagccctcagaatctactggctgaatgagtgcgtggaggaaatgtgctcagagctgctgtgtgtcatcctgtgtttgaagtgctcctgcagctatcattcatccagttaagaatttgaagaagtgtgtgcacaaagacggagtctcactctgttgcccaggctggagtgcagtggcacaatctcggctcactgcaacctctacctcctggattcaagcggttttcctgcctcagcctccagagtaacagggattacaggcatactccaccttgccctgctgattttgtatttttagtagagacaagagtttcaccatgttggccaggctggtcttgaactcctgacctcaagtgatccactgcctcagcctcccaaagtgctgggattataggcgtgagccactgcgcctggccaaatgctctactttttaatcaatgttttccaaaatagggatttttgctatgtgctttagaaattagagaacaaacggtgataatatatgctaaacttaaaattagtatgcctccttttatagacaacaagaactttgtcacttcccagtttgtcttgtcattcaggaggctcagagctacgatctgtgcccactcgtgctgcctcttcttaactttgatttcctgaagcagcgatttcatctccgtttcccctcatcacctgttcttttaactgtttaaaaacagcattacatgttgttgcaagtggcctcaaattctttttggtagaagggaaattgtaatccatgagaagaaaaaaattttcctaactattctcaggtgtgtttaagggctgcattccatgatgctatcagtgccttctttcagctcacaggatatcggccatgttaatgagtctgatgttgctagtatcacaggcaccggaaaatatgcacattatgctggagcattagaatgcaacagaaagagccctgggcttggagtatgcagaactggttcttgttacaactcctcttactagtgggctctggaagaaaacacattgaattcatgatcatggttaacctttggagagagagaggagaccaggatgaaggagccagtcgaagatcctgttcaagtgtacactgagccagcaggttcaccagaaagctattgagcgtttgctggaacacattatgcagggtgaatttcttctggaatgttgccaaggattttttatgcttctgtggcaggcatttcttgaacattgtcatttagccaagcaaagaagattttcttaaaggatagaaaatgtttaaaaatttttgtttgtttgaagataggttaaatggctatatgatctcaggataagacagagaaaatcacttatttctctaagtgatctgattaggttagtgatgttttgcctttaaacagattcatcattattcctaaagtattgctgtattaatactgtcttctagaaagtatccaccagtgcctacttttcttcgatatcattagctgtttttcgaaactgaatttgctcttcagagatttctcatatgtttgcgtataaggaactactggtaatagccaagaaaatttggaggtgcagagaacatgctgaaacagaatttttcactttcaattctagaactatgccataaaaaaaaaggaaaatgtaaaaatgtctttatattagagcagatattttaaaagtattgcaaattcaatgataaattctaaggttaaaattggacacataaaaaatacaatatataaa

SEQ ID NO: 276829 - DNA, 1267 bp, Homo sapiens
cgcgcggccgcggcgctacctttctccaaacaacgttgccacacgcggagagcacggagatttctggggctttggagggaatcgtgagcgggcgggaggaggccggggaccacacagagaataacttgtctgactaccagtattcttggatgcagaagtgctgaagatgagcacacacacgtacggagaatttctggagaattcagctgctcagaacaagaactgagatccagagagatgatgactttgcccatagaccaaacaaagaaatacatgtttcagtcctgtgtcctcctgctatgtgtgtccggaattggtgggttcttggtctcactgacttcaagaatgaagctgcggaccctcgcgctcacaggatatcggccatgttaatgagtctgatgttgctagtatcacaggcaccggaaaatatgcacattatgctggagcattagaatgcaacagaaagagccctgggcttggagtatgcagaactggttcttgttacaactcctcttactagtgggctctggaagaaaacacattgaattcatgatcatggttaacctttggagagagagaggagaccaggatgaaggagccagtcgaagatcctgttcaagtgtacactgagccagcaggttcaccagaaagctattgagcgtttgctggaacacattatgcagggtgaatttcttctggaatgttgccaaggattttttatgcttctgtggcaggcatttcttgaacattgtcatttagccaagcaaagaagattttcttaaaggatagaaaatgtttaaaaatttttgtttgtttgaagataggttaaatggctatatgatctcaggataagacagagaaaatcacttatttctctaagtgatctgattaggttagtgatgttttgcctttaaacagattcatcattattcctaaagtattgctgtattaatactgtcttctagaaagtatccaccagtgcctacttttcttcgatatcattagctgtttttcgaaactgaatttgctcttcagagatttctcatatgtttgcgtataaggaactactggtaatagccaagaaaatttggaggtgcagagaacatgctgaaacagaatttttcactttcaattctagaactatgccataaaaaaaaaggaaaatgtaaaaatgtctttatattagagcagatattttaaaagtattgcaaattcaatgataaattctaaggttaaaattggacacataaaaaatacaatatataaa

SEQ ID NO: 276830 - DNA, 2468 bp, Homo sapiens
agccgccacactttcccaagcccgcaggcgccccccccaacaccagcgctgcacccccgacccattccccgcggccccctccaggagaaaaaatgaaaccagactggccgaggaggggggcggcagggaccagggtgcggagcagaggtgagggagacgggacttactttgcgaggcgcggtgcagggcgccgccgacgagaaataaaggccccgatacgggctgcctggagccccccgagcgcagcaatgtcagggctccagtccgggcggcgttggcggccgcaggggacggggacgggcgcgcgtgcggcgggcgctctcgctgcgctccggctcgggccccggctccgcgcggctccgctcctggctcccctctggctcctggcaccaactccggacagtcacatgacgccggcgccgctcgctctgcgagcctcccggggctggcgggagaataacttgtctgactaccagtattcttggatgcagaagtgctgaagatgagcacacacacgtacggagaatttctggagaattcagctgctcagaacaagaactgagatccagagagatgatgactttgcccatagaccaaacaaagaaatacatgtttcagtcctgtgtcctcctgctatgtgtgtccggaattggtgggttcttggtctcactgacttcaagaatgaagctgcggaccctcgcggaccgtgtgtgaatgcctgctctgtgagccctcagaatctactggctgaatgagtgcgtggaggaaatgtgctcagagctgctgtgtgtcatcctgtgtttgaagtgctcctgcagctatcattcatccagttaagaatttgaagaagtgtgtgcacaaagacggagtctcactctgttgcccaggctggagtgcagtggcacaatctcggctcactgcaacctctacctcctggattcaagcggttttcctgcctcagcctccagagtaacagggattacaggcatactccaccttgccctgctgattttgtatttttagtagagacaagagtttcaccatgttggccaggctggtcttgaactcctgacctcaagtgatccactgcctcagcctcccaaagtgctgggattataggcgtgagccactgcgcctggccaaatgctctactttttaatcaatgttttccaaaatagggatttttgctatgtgctttagaaattagagaacaaacggtgataatatatgctaaacttaaaattagtatgcctccttttatagacaacaagaactttgtcacttcccagtttgtcttgtcattcaggaggctcagagctacgatctgtgcccactcgtgctgcctcttcttaactttgatttcctgaagcagcgatttcatctccgtttcccctcatcacctgttcttttaactgtttaaaaacagcattacatgttgttgcaagtggcctcaaattctttttggtagaagggaaattgtaatccatgagaagaaaaaaattttcctaactattctcaggtgtgtttaagggctgcattccatgatgctatcagtgccttctttcagctcacaggatatcggccatgttaatgagtctgatgttgctagtatcacaggcaccggaaaatatgcacattatgctggagcattagaatgcaacagaaagagccctgggcttggagtatgcagaactggttcttgttacaactcctcttactagtgggctctggaagaaaacacattgaattcatgatcatggttaacctttggagagagagaggagaccaggatgaaggagccagtcgaagatcctgttcaagtgtacactgagccagcaggttcaccagaaagctattgagcgtttgctggaacacattatgcagggtgaatttcttctggaatgttgccaaggattttttatgcttctgtggcaggcatttcttgaacattgtcatttagccaagcaaagaagattttcttaaaggatagaaaatgtttaaaaatttttgtttgtttgaagataggttaaatggctatatgatctcaggataagacagagaaaatcacttatttctctaagtgatctgattaggttagtgatgttttgcctttaaacagattcatcattattcctaaagtattgctgtattaatactgtcttctagaaagtatccaccagtgcctacttttcttcgatatcattagctgtttttcgaaactgaatttgctcttcagagatttctcatatgtttgcgtataaggaactactggtaatagccaagaaaatttggaggtgcagagaacatgctgaaacagaatttttcactttcaattctagaactatgccataaaaaaaaaggaaaatgtaaaaatgtctttatattagagcagatattttaaaagtattgcaaattcaatgataaattctaaggttaaaattggacacataaaaaatacaatatataaa

SEQ ID NO: 276831 - DNA, 3023 bp, Homo sapiens
cctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtgggttctccctgatgtctttattggaaagcctggacccagactggacccctgaccagtatgattacagctacgaggattataatcaggaagagaacaccagtagcacacttacccatgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggcatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaagaaaaaaaaaagtttg

SEQ ID NO: 276832 - DNA, 3105 bp, Homo sapiens
  misc_feature (315)..(315): n is a, c, g, or t
cctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtgggttctccgctgatgtctttattcgggaaagcgctggagcccagagctggatcccatggaccagctagtgattacagcgtacgcaggattagtaccatcagcgtagagcagacacagcgcgacggtagccgaacaaactgtagccgcagtgncgtgcagtaattcgctggagctggctatcatagcacatgtgatgtgacacagaagcatggagtcgcatgcactgaccgcatagcacgcctggtgaacgagcaggtagggagacatggccgtctgtcctatgtggagtcagcttcacgattgcagcgtgggctggcttccgtttctctgggaataagtgtcagaatgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggcatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaagaaaaaaaaaagtttg

SEQ ID NO: 276833 - DNA, 2969 bp, Homo sapiens
cctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtgggttctccctgatgtctttattggaaagcctggacccagactggacccctgaccagtatgattacagctacgaggattataatcaggaagagaacaccagtagcacacttacccatgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggcatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaacaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaagaaaaaaaaaagtttg

SEQ ID NO: 276834 - DNA, 1485 bp, Homo sapiens
ggctggcggccccgccccgccccgcccggctgctccatggcgctgtgcgaggccgcgggctgcgggagtgccctgctctggcctcgcttgttgctcttcggggactccatcacccagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttcagggaagttttatacttaggtccattgtgtttcgacagtatttattaatgcagatatcagtgctacagctataaaatataccctgagcagcttgttaattctataaatgacaaagactatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggggtaggaggagatatgattagtcacaggtttggttaactgccctcaaaatttacaagttaaaatgttttggctggtgagcacatttcagttcttaggggaaaaaaagcttttaatggcaatttatagaaatcagaatccaggctaatgatttttatccttcacacagtaaatgcagcccatccagaatcctggagcaataaagtaagaagtaattcaaata

SEQ ID NO: 276835 - DNA, 1432 bp, Homo sapiens
ggctggcggccccgccccgccccgcccggctgctccatggcgctgtgcgaggccgcgggctgcgggagtgccctgctctggcctcgcttgttgctcttcggggactccatcacccagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttcagggaagttttatacttaggtccattgtgtttcgacagtatttattaatgcagatatcagtgctacagctataaaatataccctgagcagcttgttaattctataaatgacaaagactatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggggtaggaggagatatgattagtcacaggtttggttaactgccctcaaaatttacaagttaaaatgttttggctggtgagcacatttcagttcttaggggaaaaaaagcttttaatggcaatttatagaaatcagaatccaggctaatgatttttatccttcacacagtaaatgcagcccatccagaatcctggagcaataaagtaagaagtaattcaaata

SEQ ID NO: 276836 - DNA, 1557 bp, Homo sapiens
gaatgagggccctaggttggatcttagttgtaaagctcccccaggtgatccaagcgagcttgggacgagcaacctaaagaaagtcatgctctacgcccatcgccccgccccagggagcggggtcggcctctgcgccggcgcccctggcccttctgttactcatctacagctccgtgatttcaaggcatccttcccacccgttcgtttttagctcggctgccgaacttcattgcacagttgagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttcagggaagttttatacttaggtccattgtgtttcgacagtatttattaatgcagatatcagtgctacagctataaaatataccctgagcagcttgttaattctataaatgacaaagactatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggggtaggaggagatatgattagtcacaggtttggttaactgccctcaaaatttacaagttaaaatgttttggctggtgagcacatttcagttcttaggggaaaaaaagcttttaatggcaatttatagaaatcagaatccaggctaatgatttttatccttcacacagtaaatgcagcccatccagaatcctggagcaataaagtaagaagtaattcaaata

SEQ ID NO: 276837 - DNA, 900 bp, Homo sapiens
ggctggcggccccgccccgccccgcccggctgctccatggcgctgtgcgaggccgcgggctgcgggagtgccctgctctggcctcgcttgttgctcttcggggactccatcacccagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagagtaaatgcagcccatccagaatcctggagcaataaagtaagaagtaattcaaata

SEQ ID NO: 276838 - DNA, 1752 bp, Homo sapiens
gcgagagcccgggctccaggcacagacgcgaggggacccggccgcgctgcccgccccgcgccgcctcccacccgggtcgagatgcgcggtcttcccctcagcgccctcctgggcagcggcctttcccctccgggtccgggttagcggccgcgggcgaccgcgcgctgtgtcccaggaggccccgcggccagctccgggcagaggcgccaggagctctctcgccccattccctgcgggcacaggtggggccgttaggggttgaccttggaagtaaaacgccttcaggaattagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggccatatttacctgttaaggttctttcaaataacctgagaatcatgtcatatgattcagaagacctggaatgaggtcccagctcacttaatggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttcagggaagttttatacttaggtccattgtgtttcgacagtatttattaatgcagatatcagtgctacagctataaaatataccctgagcagcttgttaattctataaatgacaaagactatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggggtaggaggagatatgattagtcacaggtttggttaactgccctcaaaatttacaagttaaaatgttttggctggtgagcacatttcagttcttaggggaaaaaaagcttttaatggcaatttatagaaatcagaatccaggctaatgatttttatccttcacacagtaaatgcagcccatccagaatcctggagcaataaagtaagaagtaattcaaata

SEQ ID NO: 276839 - DNA, 873 bp, Homo sapiens
  misc_feature (158)..(158): n is a, c, g, or t
atataacccccataatttttaatatattgtgtgaaaatcttttcgccacatattgatggtgttacgcccataagaccgctagttgattatttcgcatggcggtatataattggtttggttggtgttcttccagttggtctctcccccacaatttgggntttcttcctcctaaaaaattatcctcaatagacgtgagtttttttgcaccaatcagaggttgttgttgttacactgcggcgccgtttccggggtttttgagccccccttggggggcccccttgttttgccacaaggggggcgcgccgtggggggccccccgcgggggtttttttttgggcgcgcccccccctcttttttttttttttttttgtttttttttttttttttttttttttttttttttttttttttttttttttttatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggggtaggaggagatatgattagtcacaggtttggttaactgccctcaaaatttacaagttaaaatgttttggctggtgagcacatttcagttcttaggggaaaaaaagcttttaatggcaatttatagaaatcagaatccaggctaatgatttttatccttcacacagtaaatgcagcccatccagaatcctggagcaataaagtaagaagtaattcaaata

SEQ ID NO: 276840 - DNA, 1730 bp, Homo sapiens
gcgagagcccgggctccaggcacagacgcgaggggacccggccgcgctgcccgccccgcgccgcctcccacccgggtcgagatgcgcggtcttcccctcagcgccctcctgggcagcggcctttcccctccgggtccgggttagcggccgcgggcgaccgcgcgctgtgtcccaggaggccccgcggccagctccgggcagaggcgccaggagctctctcgccccattccctgcgggcacaggtggggccgttaggggttgaccttggaagtaaaacgccttcaggaattaggtagaaaaggaccatccgttcatccaagatcatctcacctcccatgaagggaacggtcttctaaatgcagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttcagggaagttttatacttaggtccattgtgtttcgacagtatttattaatgcagatatcagtgctacagctataaaatataccctgagcagcttgttaattctataaatgacaaagactatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggggtaggaggagatatgattagtcacaggtttggttaactgccctcaaaatttacaagttaaaatgttttggctggtgagcacatttcagttcttaggggaaaaaaagcttttaatggcaatttatagaaatcagaatccaggctaatgatttttatccttcacacagtaaatgcagcccatccagaatcctggagcaataaagtaagaagtaattcaaata

SEQ ID NO: 276841 - DNA, 1681 bp, Homo sapiens
taattttagtagagacggggtttcgccatgttgaccaggctggtctcgaactcgagacctcatgtgatccgcccgccttggcctcccaaagtgctgggaatacaggctgtttagcttttgatagagaaaaatccccctctgctaaagtgctgccaggtgtacttacctgtaatccccaaaatgacctcctggagtgaagcaatcaaagccaagaagggagcgccgagaaaacagaagttgccaatcagaactgccctcgctgagatgcccggttacagtcattagtagtaataatgggcttttcttcctccagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttcagggaagttttatacttaggtccattgtgtttcgacagtatttattaatgcagatatcagtgctacagctataaaatataccctgagcagcttgttaattctataaatgacaaagactatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggggtaggaggagatatgattagtcacaggtttggttaactgccctcaaaatttacaagttaaaatgttttggctggtgagcacatttcagttcttaggggaaaaaaagcttttaatggcaatttatagaaatcagaatccaggctaatgatttttatccttcacacagtaaatgcagcccatccagaatcctggagcaataaagtaagaagtaattcaaata

SEQ ID NO: 276842 - DNA, 1400 bp, Homo sapiens
ggctggcggccccgccccgccccgcccggctgctccatggcgctgtgcgaggccgcgggctgcgggagtgccctgctctggcctcgcttgttgctcttcggggactccatcacccaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccaggacttctcatcttatttatcagatggactacatttgtctccaaaggggaatgaatttttgttctcgcatctctggcctttgatagagaaaaaggtctcttctctacctttgctgcttccttactggcgggatgtagcagaagcaaaacctgaattaagtctgctgggagatggagaccattagccaatcacaggagacccaaatctgcttgttatctacagaactcaaagttgtcaatacgtagaggtacgcttttttcctcaggcttaaacctttgccactgatattaataataaaagtattagatgatttttcagggaagttttatacttaggtccattgtgtttcgacagtatttattaatgcagatatcagtgctacagctataaaatataccctgagcagcttgttaattctataaatgacaaagactatgtttttaaaaagtcacaattttataaaaatggtttttcttacattcttttgagaactgtttcactcatacatacacccacacaccccactcaaccttgtatcaaattccaaaagtgtaactaaagtataagaatatcatgactagttaaaagatagcaaataccataaggtacaagttcaagtattagtataacaagtatctgagtaacaaatgtccttggaaatggggggtaggaggagatatgattagtcacaggtttggttaactgccctcaaaatttacaagttaaaatgttttggctggtgagcacatttcagttcttaggggaaaaaaagcttttaatggcaatttatagaaatcagaatccaggctaatgatttttatccttcacacagtaaatgcagcccatccagaatcctggagcaataaagtaagaagtaattcaaata

SEQ ID NO: 276843 - DNA, 1447 bp, Homo sapiens
ggctggcggccccgccccgccccgcccggctgctccatggcgctgtgcgaggccgcgggctgcgggagtgccctgctctggcctcgcttgttgctcttcggggactccatcacccagttttccttccagcagggtggatggggagcatcgctggctgacaggctggtcagaaaatgtgatgttctgaatcgtggattttcaggttacaataccaggtgggccaaaattatccttccaagattaatcaggaaaggaaacagtttggacatcccagtagcagttacaattttctttggggccaatgacagtgcactaaaagatgagaatcccaagcagcacattcccctggaggagtacgctgcgaacctaaagagcatggtgcagtacctgaagtccgtggacatccctgagaatcgagtcattctcatcacgccgaccccactttgtgaaacagcctgggaagaacagtgcatcatacaaggttgcaaactaaatcgcctgaactctgttgttggtgaatatgccaatgcgtgtttacaagtggcccaagactgtgggactgacgtacttgacctgtggaccctgatgcaggacagccagggtacggtggcttgctcggtcctctcggggtaaataggatcacacagaagtaaaccaggtgtgtgtgcagcagctttccctagaaaggccctgcttagctaagacagtcatccctatagccaatgaaaacaaacaggcttgggggaggggaggaatggaggttccaggatggctcacaagcccagcagcttaattcagccaggctccttggctaggagttagtgcgcagtgacatcaatgagcaacacatggctcatatttatgaacgtccaggccaagttcttctttcatacagagaatggcagaaagctaaaacttgttaataggtaaaacaatgaatttaaatacagtattggctaataaaactgtttgagatatgtagttctaattaagttactttgttttaaagcctgaaagcacaaatataaaaggtaaaaagcaggtcccatggaatggtgcactgactcaggagacagctggtttctgacgcagtcacacatacacttagggaggacctggcagtccactcctgggttatctgccctagagaaatgaaaactatgttcacacagaacctgggtgtaactgttgacagcagcattattcctacctgctggaaacacgccagtgtccttctgtgatgaatagggaaactggtgtgtccgtggaatgggatactactcggcaataaagaggaggaactgacaagcgcagcaacgtgggtgactctcgaggcgcttcactgagggaaggaagctggtctctgaaggctacttactacatgagtccatctgttttggtgtctcaaaaaggcaagacttgggctgggtgtggtggctcacacctg

SEQ ID NO: 276844 - DNA, 910 bp, Homo sapiens
  misc_feature (85)..(85): n is a, c, g, or t
gctgtgagtgaggaatgcctctcaccagctgtgcctgagctgcagcactccagccactgctgtctccttagctgctcacatatgnatactttcacagttcaggattccactgcaatgagctggtggaggaataatttctggatcatcttagctgtggccatcatcgttgtctctgtgggtctgggcctcatcctgtactgtgtctgtaagtggcagcttagacgaggcaagaaatgggaaattgccaagcccctgaaacacaagcaagtagatgaagaaaagatgtatgagaatgttcttaatgagtcgccagttcaattaccgcctctgccaccgaggaattggccttctctagaagactcttccccacaggaagccccaagtcagccgcccgctacatactcactggtaaataaagttaaaaataagaagactgtttccatcccaagctacattgagcctgaagatgactatgacgatgttgaaatccctgcaaatactgaaaaagcatcattttgaaacagccatttcttctttttggcaaaactgaagagggttcacacaacttattttaaaacaatcaagaatggttgaacttcagtaggtctctgggccctgaaagccagtggtgattttatgaagctctataagataaagcacttcccaaaccttagatgaagacacccctgcgatcggatgactgcagccagaggagacacatgggtgctcggctctgaggacttagaggggtcagccttgtgctgttgaggaaactttccatgggaaggaccacggggctccatggctcccacctgtgggaaactactcatttcttggcattctttcccccttcattccctttggtttgcatggttctgagtgatattaaatctcagcatttggttgtgca

SEQ ID NO: 276845 - DNA, 1236 bp, Homo sapiens
  misc_feature (85)..(85): n is a, c, g, or t
gctgtgagtgaggaatgcctctcaccagctgtgcctgagctgcagcactccagccactgctgtctccttagctgctcacatatgnatactttcacagttcaggattccactgcaatgagctggtggaggaataatttctggatcatcttagctgtggccatcatcgttgtctctgtgggtctgggcctcatcctgtactgtgtctgtaagtggcagcttagacgaggcaagaaatgggaaattgccaagcccctgaaacacaagcaagtagatgaagaaaagatgtatgagaatgttcttaatgagtcgccagttcaattaccgcctctgccaccgaggaattggccttctctagaagactcttccccacaggaagccccaagtcagccgcccgctacatactcactggtaaataaagttaaaaataagaagactgtttccatcccaagctacattgagcctgaagatgactatgacgatgttgaaatccctgcaaatactgaaaaagcatcattttgaaacagccatttcttctttttggcaaaactgaagagggttcacacaacttattttaaaacaatcaagaatggttgaacttcagtaggtctctgggccctgaaagccagtggtgattttatgaagctctataagataaagcacttcccaaaccttagatgaagacacccctgcgatcggatgactgcagccagaggagacacatgggtgctcggctctgaggacttagaggggtcagccttgtgctgttgaggaaactttccatgggaaggaccacggggctccatggctcccacctgtgggaaactactcatttcttggcattctttcccccttcattccctttggtttgcatggttctgagtgatattaaatctcagcatttggttgtgcagaccctcccaggctcccatccccagcaaggccctcaccaagcatgctggtctttaccctctcaccccacccacctcctgcactgtgaggctgtgggtgagttacagctgagtgctctcgtgcccaggttcccacaccacatctcgcgagtttgcaagggcagggagtaccttttgttctcgtgaaccctccccacctagacaccctgcaaaccccagtgcctttatatgatgtaggccaaattgaccatagagatttgagttttcacctaggttttctccccgtgcttgcaagttgtactgtaacaatggacaaaggacaaaagtt

SEQ ID NO: 276846 - DNA, 1342 bp, Homo sapiens
cccaggatttcacctcctatcgcggccatacggatgtccccggccgtccctcttaatcatgggttcagttcagattgtagccatacttaaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 276847 - DNA, 1043 bp, Homo sapiens
ccttgacctgagacttgccatcaaactcctccagctcaggccccgaagcccgctattccagcggctctggttcatgaggctctcacggatttttgtcttgtggctccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 276848 - DNA, 1873 bp, Homo sapiens
tccgagcgcacacgggagctctttcccttctctcctcctcctcgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggtaagcgaatccacttgctaactagaaggaacttccttcttggaaaatggataatatttagtggccagatgtttggtcgtattttatgtcagttgggcagtttcatctttgcagagaatatagccagatgtgaatggaattatttcatggcaaaaagaaacatttgcatgtactcctatacctccatccttcttccttcttttcctctaccataaagttacacctccccagcctaattctgagctaaacaacgcacaagtttaagaactgcacattctccaagtttctgtctcctttaaagggctcagcagtaaataacttaagttattctgacatctgcgtttgagaaatgcgtgaccattacttcctgaattaatttgggaatctttgacctgcgtcctgatttaagaccatcctgaaagctcagggttatgtgccctttcaggtctttgttttccaaacatatgctcccttatctctttaattgtgcttttctcttggagaagaagaaaagtgagcaatttttgattctggatgatgtggatatggaaagataaatataagcattgcaaaaagtttctcctggtagctttaaacatacatacacccttccaaatgcctcaaaacaaaaagccaacccttatcctcactccctgctctagataactgccaccggaagccactcatattcctgctgcctctagattaagtttttctgatacaagat

SEQ ID NO: 276849 - DNA, 3813 bp, Homo sapiens
acgcacgcagacacattctccctctctgcgctctctccttcggtctccctctctgcctctttctctttcacttttgcatgccctgcaaccttttaaaatgttgccccttccctgtgattcgccagacgccgcgccgcggccccccgcgcgctcgcccgctccctctctcgctcgctttttgtctctcgcgctccctctccccactccgatttgctacactgagactcccgtcaatggactgcattgagagccggctccggcgcgagttgcctctccgcttcacgctcgatttccaggcattcttcccttattaagtattcgtgtaatattaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgcctttgtgtggggcgcgctcgggcggcggggcagccgggcgctccaggcttgcttgtttttttccaccctgactcgttaccccagactcttcgcagatgttagttcacagtttttcagccatggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 276850 - DNA, 3175 bp, Homo sapiens
tccgagcgcacacgggagctctttcccttctctcctcctcctcgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 276851 - DNA, 3235 bp, Homo sapiens
aaaaacccatgctctcaggcctagggtttggcctgctcaggctatggccgctgctgggagggtgtcggtgctcctggcagcccagatcctgacttcaaaccactgcactggcgacaggctgggacagccctgcagggtctagccctggaaagtcgaccattttctggacggagggcggcgccaagcctccagcccggttcagccgaggaattgtgctcagttcaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 276852 - DNA, 2504 bp, Homo sapiens
ttgataggtgtgaagttggaatacaagaagcattttaaaagagaatttggagaagtgtcatttagggtgggggatgggactggaggttggtggatgagattttcattttcaagtcttcttggccctctaggagaagtggtcatttttcctgataaatgcatccaccagatcctacagagaaggaaataaaatgcctgaaatgagaaaacaagtagtttgtgtttcctgcaacatctggggtgaagggaattagggagttgggagtggggaggaagttaggatccccactcttcattctctcgcactggctccctcctctcccctcttgccaggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 276853 - DNA, 2422 bp, Homo sapiens
acgcacgcagacacattctccctctctgcgctctctccttcggtctccctctctgcctctttctctttcacttttgcatgccctgcaaccttttaaaatgttgccccttccctgtgattcgccagacgccgcgccgcggccccccgcgcgctcgcccgctccctctctcgctcgctttttgtctctcgcgctccctctccccactccgatttgctacactgagactcccgtcaatggactgcattgagagccggctccggcgcgagttgcctctccgcttcacgctcgatttccaggcattcttcccttattaagtattcgtgtaatattaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgcctttgtgtggggcgcgctcgggcggcggggcagccgggcgctccaggcttgcttgtttttttccaccctgactcgttaccccagactcttcgcagatgttagttcacagtttttcagccatggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggtgcagagatggcagcggttctgaggcaagagtactgaaatttgctttataatttacttgattatccaagttgtgcatttgaagaaacacatccatgtttccgtagtgcttagtgctatgggtgaaagaaatcttaaagtcaagcagagaagaaaaaaataaaacccacgcatacctcagaaaagcccaattcaactcctaacatcacccaaccaccccatcccagaagaatgaaaccatggagcacaacaggacccgaggtccagttgaattgagagcccaccccaggcgggaagacagccagctcctgcattcaattctgcctgtaggaagcaagggttgtggagacggccggcgaccccgctgggagcaaacacaggctccccttggctttcagacctggggcgcaaggactttctttaggctacggagagatctgtgtcttgttctggaaaacccagggcgttccctcccttctctaggcctctggagtagctgatttagcaaacgtatggacagccatgccagcagtacctcagtttccctaatgcggagaccaaggagggaagtttttgagaagacctgggacacgcttgtttctcgggaaatcaacgtgggggccggcaggaggagggagatcagtctcttccctgtagtccaaggtggtgtttcctggcgcgggaccctgggcagtcccagtaatccaatcccagcccagaacaatcagggcaagacgcggcgcaagctctccgccaccatctccattttacacattgtcaaa

SEQ ID NO: 276854 - DNA, 3318 bp, Homo sapiens
tccgagcgcacacgggagctctttcccttctctcctcctcctcgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 276855 - DNA, 3199 bp, Homo sapiens
ggtcggcaggtagcaacccagctctttatgaccaggtgagatgttggtgagcaggtaaaaaaggaggatttgcctaagcgattccagggagctggcccgaccgagccctccagcccatgcccggcggggaccagtcgccaggagcgcagagccgcgatgtccatacttgccaaaatgggggactggcaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 276856 - DNA, 3134 bp, Homo sapiens
ggcctatttatcaaaaagacgggacgtgtggtgtggacaacaaaatccaccacttcccagcgtggtgcctcaattaaaacgctcgtttacagggtgctttagccatctaaattgtcggctgattttaataatgggtctttgaagcagtttttccccgacactaaaaccccacccagcaaaacccctgaagtacaagtaacttgctctcggtttgcaaatgtaattccctcccctgcaccctgaacccgtggtcctggacctcatctggggcccactccgctcggatgctcagcgcctcaggggtcaccaatttcaccacccatctctagagagcacccttgacggcgaaggggaaagggtcaaggcagaaacgcaggccaggctggctgggggagggcagggccgcctcccggccgccgggtgaggtagggaagggctcgagcccgaggaagggaagtagcagagccacagaatttcagagccggacggaaaagcggggactgtggcccaaagcctgggatccggccctggccgggatgagggccggggtcgggcaggatttgggggtgatccacgacgcccaacacgcggcctcccctctgtctccgcaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 276857 - DNA, 2280 bp, Homo sapiens
acgcacgcagacacattctccctctctgcgctctctccttcggtctccctctctgcctctttctctttcacttttgcatgccctgcaaccttttaaaatgttgccccttccctgtgattcgccagacgccgcgccgcggccccccgcgcgctcgcccgctccctctctcgctcgctttttgtctctcgcgctccctctccccactccgatttgctacactgagactcccgtcaatggactgcattgagagccggctccggcgcgagttgcctctccgcttcacgctcgatttccaggcattcttcccttattaagtattcgtgtaatattaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgcctttgtgtggggcgcgctcgggcggcggggcagccgggcgctccaggcttgcttgtttttttccaccctgactcgttaccccagactcttcgcagatgttagttcacagtttttcagccatggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggaccacggaaaccccatccactacccatccccttcccatgtgaggccgaccaccccggccccccaaccacccctaaaataagacgccaacccaaggcctgacatataagcccccaatcaaccaacctctcccgaaacatgccaaggaactgcccgccccagaaataccccaaatagtctgtgcagattaggaagagaccggtggcttcgcccaccctctctgtaaactctggtactgtgtcctctgcgctgcccca

SEQ ID NO: 276858 - DNA, 2016 bp, Homo sapiens
acgcacgcagacacattctccctctctgcgctctctccttcggtctccctctctgcctctttctctttcacttttgcatgccctgcaaccttttaaaatgttgccccttccctgtgattcgccagacgccgcgccgcggccccccgcgcgctcgcccgctccctctctcgctcgctttttgtctctcgcgctccctctccccactccgatttgctacactgagactcccgtcaatggactgcattgagagccggctccggcgcgagttgcctctccgcttcacgctcgatttccaggcattcttcccttattaagtattcgtgtaatattaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgcctttgtgtggggcgcgctcgggcggcggggcagccgggcgctccaggcttgcttgtttttttccaccctgactcgttaccccagactcttcgcagatgttagttcacagtttttcagccatggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggtgcagagatggcagcggttctgaggcaagagtactgaaatttgctttataatttacttgattatccaagttgtgcatttgaagaaacacatccatgtttccgtagtgcttagtgctatgggtgaaagaaatcttaaagtcaagcagagaagaaaaaaataaaacccacgcatacctcagaaaagcccaattcaactcctaacatcacccaaccaccccatcccagaagaatgaaaccatggagcacaacaggtaatatcagttttcacacctctgcatccccttttaggatgctccgggatatttttccttgtgaatttcagtgaacgattcttttctatattaaacttggtttactacctgagttgcacaggt

SEQ ID NO: 276859 - DNA, 499 bp, Homo sapiens
gtttcatgggagaagcgctaaactttacctcaacatttatgtaaagttaaagctgcacagaataaaccaagattctgagtcttgaaagtttatttcaaagaaaagacaatgcctgtgccacatatttgacttggttttaatttgcagtagaaagaataagaacaagaagaggggaggaaaggaggtgtcagaaggcaaaaagaagagtactttgaggctcttcggagacctagagtaaaaaatactgccattaaatggagccaccatgagttttataaatattacgaagctccaggaaatatgagcaggatctcaaatatattcaacaagcttccaatttttgtcttttgagatggttgctcttggaacacagaaatatgctttaagatgtcaagcctcctctgctgatgctgtatggagaacagacaagctttcccatcaagccctaaccaaactgcagaactgtgaataaaatcaataattgttatgaaaaggcaaa

SEQ ID NO: 276860 - DNA, 653 bp, Homo sapiens
agactttttattgaagccaatttttattagttatacatcactaccttgttttatattttttcctaatgttaagggtcagttcattcttttcaactccaaatattttacagaaaataaatgggaaaaaaaccagagtatttatataaatgatcctcataaggataagcctttacatttaaaactttagtcaacaataataactacacataaaggttgataagaatatcttgctactaagaggataatctgccactagaattaaaaaaattcatacttcctagaaacatcaattcaatcagtgatctacacaaagagttagaatataccagttcataattcttgttctaagatttcataaattattatcccaagcaatgtcatctgctagctttaaagccttctagaaagaagacactataatatctccttctgataaaactcttgcattaaattttttccttttatcgcagctgagaagtatatacacttgacccacaggtttgaaatgctctgccacccccaagactgcaagactgcaacccctccacttcctcctcatccttaacttacctaaaatgaagatgatgagaatgtacaccttgatgatgagccatttccacctaataaatagtaaatatattttctcttcctta

SEQ ID NO: 276861 - DNA, 393 bp, Homo sapiens
gtttcatgggagaagcgctaaactttacctcaacatttatgtaaagttaaagctgcacaggagacacacgttgaagtattttgcggtgaaatgttatgatgtctgcaaggaactctcaaatggttgaagaaaaatgtgtatgtcagataaagagggaagagaaaacattattttttcctgtccctcattgcttctggatgactctcaacactgagaagtatatacacttgacccacaggtttgaaatgctctgccacccccaagactgcaagactgcaacccctccacttcctcctcatccttaacttacctaaaatgaagatgatgagaatgtacaccttgatgatgagccatttccacctaataaatagtaaatatattttctcttcctta

SEQ ID NO: 276862 - DNA, 363 bp, Homo sapiens
gtttcatgggagaagcgctaaactttacctcaacatttatgtaaagttaaagctgcacagaataaaccaagattctgagtcttgaaagtttatttcaaagaaaagacaatgcctgtgccacatatttgacttggttttataaatattacgaagctccaggaaatatgagcaggatctcaaatatattcaacaagcttccaatttttgtcttttgagatggttgctcttggaacacagaaatatgctttaagatgtcaagcctcctctgctgatgctgtatggagaacagacaagctttcccatcaagccctaaccaaactgcagaactgtgaataaaatcaataattgttatgaaaaggcaaa

SEQ ID NO: 276863 - DNA, 2749 bp, Homo sapiens
atgttctgagagtcagagggagtgcaggcacagaatccaggtccccatgggggctggcaggggacagctgcacattttacaccccctggcagggctcaacctttccttagagatgggctgtgaaggttgtctgccttgagggaaggagctcctgacgtcacagagcggtggtgcttccacctaccctgtccccaaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggcgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacagacagacaaaccctctgatctatgaagtctctgcagggcaaggggaccagggacctggaaccctcttggccaaggggagtgggagggacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccaagtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaactgctgctctcaactccccacctctgggcactgaggagtatttcccctcattctacctctctaaggctatgcaaccctccccacgtcttccagctgggggatgggggggagtcataggaaaagcccccatctcccatctgggatagggaccttccatcagccttaaccctgggaaatgcctgctgcccccaatgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacaga

SEQ ID NO: 276864 - DNA, 3306 bp, Homo sapiens
atgttctgagagtcagagggagtgcaggcacagaatccaggtccccatgggggctggcaggggacagctgcacattttacaccccctggcagggctcaacctttccttagagatgggctgtgaaggttgtctgccttgagggaaggagctcctgacgtcacagagcggtggtgcttccacctaccctgtccccaaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggcgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccaggcaagtgatccgggccctgaggggaggggaggtgcacagggaggggacgtctgctccagggcgccaccgaaggcgctgtggctgccggtcggcctggaacaggtgctgcacagcctgcagccatgtgtggccaccaagacagatgtggccacagggacagatgtggccatgaaaacaggtgggcctctaaggaacagttgtggccctgggggttggacatggttccatggccacccatgctctgtaaccacagccaatcccagctggagccctggagggctggatgggtgagcggtggggggcagcccccaggctccaggcctggggtggggttgttacagacctagcctcatatacacacacactgtgctgggtgaggccccacccccaccccagaaaaggtgggctgtaggaatgaggaggagcttagggagaaacagctaggggggaggtagggcctgggggagccgccccttgccccaagagaaggagccagaacccccggatctgcatgcaaggcctgctccatgcctcgctcacagcagcccatcccacagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacagacagacaaaccctctgatctatgaagtctctgcagggcaaggggaccagggacctggaaccctcttggccaaggggagtgggagggacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccaagtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaactgctgctctcaactccccacctctgggcactgaggagtatttcccctcattctacctctctaaggctatgcaaccctccccacgtcttccagctgggggatgggggggagtcataggaaaagcccccatctcccatctgggatagggaccttccatcagccttaaccctgggaaatgcctgctgcccccaatgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacaga

SEQ ID NO: 276865 - DNA, 1336 bp, Homo sapiens
atgttctgagagtcagagggagtgcaggcacagaatccaggtccccatgggggctggcaggggacagctgcacattttacaccccctggcagggctcaacctttccttagagatgggctgtgaaggttgtctgccttgagggaaggagctcctgacgtcacagagcggtggtgcttccacctaccctgtccccaaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggcgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccctcgcccgcctgggcagggcccggcgccgtccgtggatgagccacagaacctcttccaccttccgagcggagagaagtttccattcctcttcctcttcctcctcctcttccacctcctcctcggcctcccgtgctctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctctggtcagtgtgccttagggtggcctctcactcccaccactctgggccccttgggggaggactggggagggggccgtgggagagccctgacgctggaacctgtatacacaataaaggacagtctcacaga

SEQ ID NO: 276866 - DNA, 1951 bp, Homo sapiens
aggctaggatcgaggcctggtgttcagaccccggatctgcatgcaaggcctgctccatgcctcgctcacagcagcccatcccacagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcactgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacagacagacaaaccctctgatctatgaagtctctgcagggcaaggggaccagggacctggaaccctcttggccaaggggagtgggagggacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccaagtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaactgctgctctcaactccccacctctgggcactgaggagtatttcccctcattctacctctctaaggctatgcaaccctccccacgtcttccagctgggggatgggggggagtcataggaaaagcccccatctcccatctgggatagggaccttccatcagccttaaccctgggaaatgcctgctgcccccaatgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacaga

SEQ ID NO: 276867 - DNA, 1374 bp, Homo sapiens
tcagggagggtaggtcatctccaaatcttgaatagtaagtggccctttcacagtgccgtatcagtaaccatgaaggtaaagagattgtggactttggtaatactcactgtaaaatcacagtggtagacagtcatcagagacctatatatgcatacaagttattcagcaccaacaccaggagatatcctgtatttaggatgtaaaactttttctagagtgttttttgaaattttgctttcaattgacttggttaacaaattattgtttcctgtggatctctaaatttgaggccctaatggaaacaaactagaatcaagctacaatcatttctgttatatcagccaatcagaagagttatttgttctgtctggctatatgttgttaaattctatatggtaatgtgaaaaaatacttcagcttagagcacctctccctcccctacatacctacccacacatttctcagaggagttcttattgccacagcctttggagtaaaacagctcagagcttgaacctggctctgttgcataatagctgtagctcctcagttttcatctataaaatgaaaataacggagatgaggattaagggaaattatatacacagcactttgcagccaaatactggatacaaggtaagcactcgatcaatggtatgctgaattattttatcctacattaatgtatttgaaaaaaacataattggggatgattaatatgtcattacagatgtttttccccttttcgatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagcttggaagagaaatgaggttctcatagggtcaaagtagaatgcataaagagccaagagcagctctagacctctaccctgaagatgggagtggagagggaggtattcaaccagcaagaaatcggaaaacgcgcagagcggccgcggggtcacgggaaactgccggaggctttcagggcccagggcccggcggggaggcttcagcgggcctgcattttcttaggcatccgctccaggcgggttcaagttttcaaccagaccttcggcgatccagcgcctccagagcgtgcatcccccggcccgtgcggccccctaaggggcgggcgctgggcggcgctggacggcgcgaggcggggcggggcggggcggggcgccggacgccatcgcgtcgctaccggccggcggctgtctgaccgggactgcagccgtgtcctcgccgc

SEQ ID NO: 276868 - DNA, 496 bp, Homo sapiens
taatgtaggagaaagagctgagctggtcaggaggcctgaattccagtaccaactgtttcatttactgcttctgtattttgtcctatgactgtattttctcttctgtaagataggaataataatatctgacccttcaagttgtataactgaagagcacattttgaaagtataaatagcactacagatgtataaggtattacaattgtgggcaatgaaaatttaggttacaacattaaaaaatatgctgttttttttttttcctttctggtgcacttttctaggtgaatgtgcctcttaggagcacttgtccagaagtgtctgggaaaagcttgggctgcacagtgatggtgctccctgaaagactcagagcagcacagccagtacctccagagtatgaagcatgaagtacacttattctacaagaataagaagtaaatataaaaaaagtcaaggattcaatttttaataaagtaacaaaatcaacaaaacaaaaaaa

SEQ ID NO: 276869 - DNA, 2508 bp, Homo sapiens
  misc_feature (2482)..(2482): n is a, c, g, or t
agccctgtttgtccgccactgtttgaaaacagttggcgccgccgccgccggggcctcatttccaggtcagccccgggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttanaaaaaaaaatcgccctcgttgcctca

SEQ ID NO: 276870 - DNA, 2416 bp, Homo sapiens
attttaatacagcacctttttttggtttttgaagtttatgaacccgtttgttataaaaattgacctaataacagcttctactctgtgatgacactttattaaaatcagctcatagtggaattataagccaactgttacataaggtttacagaaagtttaaccttgttgaaggacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattacca

SEQ ID NO: 276871 - DNA, 2404 bp, Homo sapiens
agccctgtttgtccgccactgtttgaaaacagttggcgccgccgccgccggggcctcatttccaggtcagccccgggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtgaatgtgcctcttaggagcacttgtccagaagtgtctgggaaaagcttgggctgcacagtgatggtgctccctgaaagactcagagcagcacagccagtacctccagagtatgaagcatgaagtacacttattctacaagaataagaagtaaatataaaaaaagtcaaggattcaatttttaataaagtaacaaaatcaacaaaacaaaaaaa

SEQ ID NO: 276872 - DNA, 2278 bp, Homo sapiens
tcagggagggtaggtcatctccaaatcttgaatagtaagtggccctttcacagtgccgtatcagtaaccatgaaggtaaagagattgtggactttggtaatactcactgtaaaatcacagtggtagacagtcatcagagacctatatatgcatacaagttattcagcaccaacaccaggagatatcctgtatttaggatgtaaaactttttctagagtgttttttgaaattttgctttcaattgacttggttaacaaattattgtttcctgtggatctctaaatttgaggccctaatggaaacaaactagaatcaagctacaatcatttctgttatatcagccaatcagaagagttatttgttctgtctggctatatgttgttaaattctatatggtaatgtgaaaaaatacttcagcttagagcacctctccctcccctacatacctacccacacatttctcagaggagttcttattgccacagcctttggagtaaaacagctcagagcttgaacctggctctgttgcataatagctgtagctcctcagttttcatctataaaatgaaaataacggagatgaggattaagggaaattatatacacagcactttgcagccaaatactggatacaaggtaagcactcgatcaatggtatgctgaattattttatcctacattaatgtatttgaaaaaaacataattggggatgattaatatgtcattacagatgtttttccccttttcgatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattacca

SEQ ID NO: 276873 - DNA, 1792 bp, Homo sapiens
agccctgtttgtccgccactgtttgaaaacagttggcgccgccgccgccggggcctcatttccaggtcagccccgggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagcttggaagagaaatgaggttctcatagggtcaaagtagaatgcataaagagccaagagcagctctagacctctaccctgaagatgggagtggagagggaggtattcaaccagcaagaaatcggaaaacgcgcagagcggccgcggggtcacgggaaactgccggaggctttcagggcccagggcccggcggggaggcttcagcgggcctgcattttcttaggcatccgctccaggcgggttcaagttttcaaccagaccttcggcgatccagcgcctccagagcgtgcatcccccggcccgtgcggccccctaaggggcgggcgctgggcggcgctggacggcgcgaggcggggcggggcggggcggggcgccggacgccatcgcgtcgctaccggccggcggctgtctgaccgggactgcagccgtgtcctcgccgc

SEQ ID NO: 276874 - DNA, 1283 bp, Homo sapiens
agccctgtttgtccgccactgtttgaaaacagttggcgccgccgccgccggggcctcatttccaggtcagccccgggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggtttgtaaattatattagaataattttatgcctgtatttgagatttactgttatgtgtgtaaatttcatttaatatttatttgtaaaatgtattccaaaaaataaaagtgtatttgta

SEQ ID NO: 276875 - DNA, 2696 bp, Homo sapiens
agccctgtttgtccgccactgtttgaaaacagttggcgccgccgccgccggggcctcatttccaggtcagccccgggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattacca

SEQ ID NO: 276876 - DNA, 2567 bp, Homo sapiens
agccctgtttgtccgccactgtttgaaaacagttggcgccgccgccgccggggcctcatttccaggtcagccccgggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattacca

SEQ ID NO: 276877 - DNA, 2653 bp, Homo sapiens
agccctgtttgtccgccactgtttgaaaacagttggcgccgccgccgccggggcctcatttccaggtcagccccgggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaagggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagggtgactgtgaagatcacgctaaccttctgtgcagccttcttcttggatatggattagaagcctttgtttgtgttgggaccaaggcaaaaggagtacctcatgcatgggttatgacttgtggaactgatggggccatcactttttgggagagtttaacaggacacaggtacatccataaacctaccaatcctgatgaacctccagttgctgaacagcccaaaccactgtacccatatcgaacaattggttgtgttttcaaccatcagatgttcctgggaaattgtcaaccctctgatgcagtagaaacctgtgtatttgatttgaacgatgaatccaaatggaaacccatgagtgaggaagcaattaaatctgtgtgtgctcctggagctacaacatcccttcctccctttccacctctgtgtgcatccacaattgacgcgtcagtaacaagtaatgaaattgaaatgcagctgaggctcctggtgtcagaacacaggaaggatcttggcctcactactgtttgggaagaccagctctcctaccttttatcaccagctttggcttcttatgaatttgagcgtacaacaagtatatcagcaggcaatgaagaatttcaagatgccataagaagggctgtacctgatggtcacacatttaaagggttcccaatacattttgtgtatagaaatgcaagacgtgcatttgccacatgtcttcgatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattacca

SEQ ID NO: 276878 - DNA, 1564 bp, Homo sapiens
agccctgtttgtccgccactgtttgaaaacagttggcgccgccgccgccggggcctcatttccaggtcagccccgggcctgacgcggcgttgcgtcccccgggagctgcgctaggcgaacggctgcggcgctttgtgctccagtcgctcctaacgctccctggcccggccggggccgcgcagttagggcatctgaggcggggagaagcggcggggagacgccggctgccagcatgtcgctgcctccggagaaagcctccgagctgaagcagctcatccaccagcagctgagcaagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgacagtgttgagcaagaactcccttcctctccaaaacaacctatttgttttgatagacaatcgacattaaaaaaaactaatattgatccaacacggaggtatctttaccttcaggttttgggtggaaaagctttcttggaacatctgcaagaacctgagcctttacctggacaagtttgttcaacgtttactttatgtttacattatcgaaaccaacgttttcgttctaaacctgttccatgtgcctgtgaaccagattttcatgatggctttttacttgaagtacacagagaaagcttgggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggcacagaatcaaaagtttctgtgggaattttaaatataaaacttgaaatgtatccaccactcaatcaaacgttatctcaagaagtagtgaacacacagcttgctttggaacgtcagaaaactgcagagaaagagcgattatttcttgtatatgctaagcagtggtggagagaatatttgcaaattcgaccctcacacaactcacgactggttaagatttttgcacaggatgaaaatgggataaatagaccagtctgttcctatgttaaaccacttcgagctggacggcttcttgatactccaaggcaagcagcaagatttgttaatgtccttggttatgaacgagcccctgttattggaggaggaggtaaacaggagcagtggtgcactctgctggcctttctctgtagaaacaagacaaggtattatacacacataatagaattaagtagcagtatatcatagttactctgaatttgtaatccatttgtaaaagaatgccttagaaaaatgcacatatagtcaaccctctgtacccacaggttctgtatctgtagattcaaccaactgcagatcaaaaatacttacaaaagtaaaaaattacaataataaaaaatagtacaaatt

SEQ ID NO: 276879 - DNA, 648 bp, Homo sapiens
caacgggtgatgcggttggcagaggtgggagtacctgttttctgccctaattctgaccctgcttcccagagagctcgtgtagaatttgccagcctgaggttcgtgtccaggctccctgtctgtggaaggtgaccatcttcctccccctaatgggtgtggccgaggatgggctgggcctgggtcagcagggtggtctctattccacagggcctacgcttctcaggggtcaatgacacagatttccgagtctatctgcttggcaacccggtgagtgcctaaacattcccggctcaggccctggagcacttgcccgtggagagcggctgcgttctcatctgcccattcccatttctgcacaggtggtttggtggctgaatctgttgagcatcgccctctacctcctctcagggagcatcattgctgtagccatgcagagaggggcacggctgccagcggaggttgcaggtcaggtcctctgggctctccctcccctgacctggcggcagcagggcacctgcgcccctggggagggccggctgcctgctgatgggccatcctttgcgtttacaacccaaacttcccttatccttgcttttgaaaggtaacaaccccagtacccgtgctgggtaacaacactttacttcctcc

SEQ ID NO: 276880 - DNA, 6407 bp, Homo sapiens
  misc_feature (2251)..(2251): n is a, c, g, or t
  misc_feature (2342)..(2342): n is a, c, g, or t
ccacgcgtccggccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgagcacccaagggtttgctgtggaaatgtttttgctccctgatgttgctgagtaggagctggtggccttctctgtctctactgcaggtggcagagtggctgtgttctgggtcccaggtgggctggaccccccaacctccgcagacagcaggacatcagggagtgggcccggctgaggactggatagggttcaagggagaggatagattaacattcttggaagtctctttttgcatttgttttataatgtctgtcttttttttttttttttgagatagagtttcactctgttacccaggctggagtgcagtgggccgatcttggctcactgcaacttccgcctcctgggtacgagtgattcttttgcctcagcctcccaagtagctgggattacaggcacataccaccatgcccagctaatttttgtagttttagtagagatgcggttctaccatgttggccagattgttctcaaacccctgacctcaagtgatccgcccgccttggcctcccaaagtgcggggattacaggcatgagccaccgagcccggtctgaactcacaattttcatttcctgacccacggtctccatatttggaggccagtaagggcctttacagtttattatttattaagggctgattctacgccaggcactatgcgaaacgctttaccttcattatctcatttacccctcataatagtcctatgaggtagggagttattaccctgattttcaaatgaggaaatcaaaacctacagaggtaatgacttccccgaggccatcggggagtgagaggtgtatctaggagtcacaaccaggttaggttggccccaggccatcactctgctgtggtgctgctccatcacctccaaaccagctcctaacaagtttattcattcattcattcatttattcagaaaatgtgtaaagatcatccagccactgtgtgtgaggtgctggaatatacagatgaatataatatggtccccaccctctgtggtcaatggagagagagaaataaggaagcaggcagttacagtcagccaggagtgctgggagagcacagaaaagggcactcggccagtcccaggcaatccaggaaggcctctggaaggaagccgcgaagttaagataaggagccattagccatgtgatgggttgggctgggacagtagaggaagcactgggaaagttcaaggaggttagtgtacctggaacatggagcngactggtgagcaactgtgttgcagatgcaggtgccttgtccttggcacagtaacatcctggggttttgggtgtagagcctggagaggtagnagagggctggcccatgtttatcttgtgtagtgcttgggtggtgggtgttacagaaaggcttagggtttccacatattcttctctctcctcttggccattttttatgattatgactgatatattaaaagctatatataatgcatgcatagtgcctaaggaataatgaggtctcacatgcctagcaccccacgctggcctctgtttgcaggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 276881 - DNA, 4971 bp, Homo sapiens
ccacgcgtccggccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaattttaaaccaaataggctcaagaagctggctggaggtcgaattggctgacgaacatcttcttcctccaccagcttcttgagcctatttggtgtc

SEQ ID NO: 276882 - DNA, 4976 bp, Homo sapiens
  misc_feature (4660)..(4660): n is a, c, g, or t
ccacgcgtccggccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaatgcagaaaaagatgtgggggggggccccttttcttttttttccttttcttcctttgtggggggggggggaaaagggncccaaaaaaaaaggggggggtcccccccaaaaacaaattagggggggggccttgtaattagaccaacgctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 276883 - DNA, 3711 bp, Homo sapiens
tgaaattggcttaagcaacattggtttgaggttgattgtccttggccagctgtgctgatagtgatggtattctccctcctgcttcctcttccctccgcccccaccccccacccaggtcaccacctatttgcacaaggactacaacaacctgtggattatcaagaaacataacacaaactcagatcccctagacccttccttcccagtggagtttgtaagacatggagacattattcgactagaacacaaagaatgtccacttaaaaaaatctggcgatgggagcagaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 276884 - DNA, 4683 bp, Homo sapiens
ccacgcgtccggccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 276885 - DNA, 2877 bp, Homo sapiens
aaggtcacacagcaaggaaggggcagagctggaccagagcctggaatctctgcccgctccttgtcttctgactgggctgtgctgcttgggcccagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 276886 - DNA, 2580 bp, Homo sapiens
ccacgcgtccggccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagtaaagattctactcttcaccctctggttaaggatggttgggcccctggccaagacccaagtcatggccgactagcggtggcccggacttggagcacatgcagaatcagcgggcaggaactccgggagcagggacatatggcccggagagagagcagagcaaatgggccgacctggaggaggtgcacaagaaggaaggacaaagaaaggcgctccacgagagaaggcccg

SEQ ID NO: 276887 - DNA, 2278 bp, Homo sapiens
ccacgcgtccggccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcaggtcaggtcctctgggctctccctcccctgacctggcggcagcagggcacctgcgcccctggggagggccggctgcctgctgatgggccatcctttgcgtttacaacccaaacttcccttatccttgcttttgaaaggtaacaaccccagtacccgtgctgggtaacaacactttacttcctcc

SEQ ID NO: 276888 - DNA, 1983 bp, Homo sapiens
ccacgcgtccggccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcaggtaggatccaaggctggggctcctcccaggaaatggagccaagaacaagagcag

SEQ ID NO: 276889 - DNA, 314 bp, Homo sapiens
tgcagaaggaaggagagaatctcactcaccagtgctacatatgagccccattgggaaacatggcccctcaggttggtggctggggattctgaaattggcttaagcaacattggtttgaggttgattgtccttggccagctgtgctgatagtgatggtattctccctcctgcttcctcttccctccgcccccaccccccacccaggtcaccacctatttgcacaaggactacaacaacctgtggattatcaagaaacataacacaaactcaggtaatgtggtcagagactgatgcttcttgtgctgttactccct

SEQ ID NO: 276890 - DNA, 4877 bp, Homo sapiens
ccacgcgtccggccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 276891 - DNA, 6231 bp, Homo sapiens
  misc_feature (2075)..(2075): n is a, c, g, or t
  misc_feature (2166)..(2166): n is a, c, g, or t
ctctattcctggtatgtagctccttggtctcttttctctctcactgtgacttggaatctcactttcctttcaaaaggccaattccccaggaatcagcctctgtccaagagctgccgtgttttattttataccatctgaaggaaagcggaatcagagagccccttactgactctacccttcaaattgtggggctctttttccttcctgagtgtttaggttgtgctgttcctagacctcggccataatacaagagaggatttgtttcaagcaatgctgataggtcttgctggctacctgagtggatatgatggtacctttttgttccagaagcctggggataaatatgagcatcacagctacatgggaatgagaggagtaaggcttcctgacttgaaatggactgactgaaccctggggccacactaaaccagaaatgttatagttagcagccctggcgtggtggcagttctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgagcacccaagggtttgctgtggaaatgtttttgctccctgatgttgctgagtaggagctggtggccttctctgtctctactgcaggtggcagagtggctgtgttctgggtcccaggtgggctggaccccccaacctccgcagacagcaggacatcagggagtgggcccggctgaggactggatagggttcaagggagaggatagattaacattcttggaagtctctttttgcatttgttttataatgtctgtcttttttttttttttttgagatagagtttcactctgttacccaggctggagtgcagtgggccgatcttggctcactgcaacttccgcctcctgggtacgagtgattcttttgcctcagcctcccaagtagctgggattacaggcacataccaccatgcccagctaatttttgtagttttagtagagatgcggttctaccatgttggccagattgttctcaaacccctgacctcaagtgatccgcccgccttggcctcccaaagtgcggggattacaggcatgagccaccgagcccggtctgaactcacaattttcatttcctgacccacggtctccatatttggaggccagtaagggcctttacagtttattatttattaagggctgattctacgccaggcactatgcgaaacgctttaccttcattatctcatttacccctcataatagtcctatgaggtagggagttattaccctgattttcaaatgaggaaatcaaaacctacagaggtaatgacttccccgaggccatcggggagtgagaggtgtatctaggagtcacaaccaggttaggttggccccaggccatcactctgctgtggtgctgctccatcacctccaaaccagctcctaacaagtttattcattcattcattcatttattcagaaaatgtgtaaagatcatccagccactgtgtgtgaggtgctggaatatacagatgaatataatatggtccccaccctctgtggtcaatggagagagagaaataaggaagcaggcagttacagtcagccaggagtgctgggagagcacagaaaagggcactcggccagtcccaggcaatccaggaaggcctctggaaggaagccgcgaagttaagataaggagccattagccatgtgatgggttgggctgggacagtagaggaagcactgggaaagttcaaggaggttagtgtacctggaacatggagcngactggtgagcaactgtgttgcagatgcaggtgccttgtccttggcacagtaacatcctggggttttgggtgtagagcctggagaggtagnagagggctggcccatgtttatcttgtgtagtgcttgggtggtgggtgttacagaaaggcttagggtttccacatattcttctctctcctcttggccattttttatgattatgactgatatattaaaagctatatataatgcatgcatagtgcctaaggaataatgaggtctcacatgcctagcaccccacgctggcctctgtttgcaggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 276892 - DNA, 4023 bp, Homo sapiens
cgatatttgtggttctggccgaataatgtctccatgtcttacaaactccactgggaaggaagggtctaggggatctgagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 276893 - DNA, 3154 bp, Homo sapiens
acagactgaggaaagaatgtatgacaaaggcttttctcctgcatttttttcccctagtgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 276894 - DNA, 2870 bp, Homo sapiens
agagcgttggctattatgacccccattttatggattaggaaaccaaggaaccatgagattaagaaacttgccccaggacatacagctaggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactggacagctgagtgtcataaactctaaaatagtccaggctatagtaatattttctggtatttttttctgttggatttctttggttttggtttgtaagatccatcaaaaattctcagacctctgagagggccttgagggcagagaatactgacctcaccttgggatgtcaccaaaggcagagcagatgggactgtcaaagttgtgctgccctccctcccacaaacaaatgaatccagcgtggaggaaggcgcgccgccccgagctggagggcctggctcccaccatgccccccagtggctgcaggtagctggacttcctgcctgtgacgcacagagagcagcggactccggagcgtcagcctgccttagcccttggttcctcgttttttgggattgtcacactgtgacactcgggaggaacgatgtcctatcctgggctgctcaatgttcccaggccctgtgtgccagaggccaggtctctccaagtgcatctagcctggcctggagggcaaggcagatgcattctcctggctgctgggagagcccatgggaaccttgcttagcgcccaaggtagatgagagacagggcagggaatctgcgtggtgctgggatgtggggactctggcctctccagactaatgttcctgtcacctgctgagctttcccagtgtcacttctgcagtcctcctctgctcacccctccctcactccatgggcaattccctttctctctgtcactgcttcagcagtgaagacccatggcacctagaaatgcatgccagcttcctgcatctaccactctgcagctcaaacaagaagctcagagctgccccttccacttcctccccaaaagggatgaagaaaaccctgtggtagaaccaaaccacccaaggccagcccttaagcctgcctccaccttcctggtgcatgacaaaatatttcttttgtctcagaggactttgatgcttcaatatttaatgatgaatccgccacactccattttccctcctctgaagctcccaacaactctgacagggtcagatctctttaaagcatcttcaggaggcggttgccacggagactggatattggtcccagggacaggctgtgctacctactgggtggtggggagggaagcttctggccatgcttggacattcagaccaaccatcattaatgttaatagaggaaatgcagcaacgtcaaaagcaaggcaggttggttaattagatctggggcccgatgacctccctttcccactgctacagcccttttgacttcccccagcaggaagcgctgtctgtgcggctgagtctgggccacttgcttaattgcatttctggcagggaaggagaggagggatggagaagctctgctcgctgcttccacctcaccatgtgtcctcccctcccctcccttcctctcctccccacaggcggaattgctttcttctgagccgggtgggctctcctgcagggagaatgcaggggtctgtgcttggctcttagcaaagcaggtggcccacagtgacctccaggaggtggctgattttcctttgtgccttcttatttctcagtaggaacttggaagggaagagctctgaaggagccagaggggcagtcaccttacatgagggtgaggaaggagaagcccagccagcctctacccatccctccctcccaattaggctgcactggggccgaacgcttccctgggctcccactgccttctaaggagccaaggagaattccctgcccactttctgttcctccatgcccaaactggcagatgcttctctgggagcaaggccacatgggctgatgcagctttgagtgctcaggttctgttttctggaagttgctggagaagggctgtcagggtgcttctatgaatatgggcttcagctgtagcacttggcagaaacgtgatgtgtcccacaaactgctggtggaggaagaagatgttcgtcagccaattcaacctccagccagcttcttgagcctatttggtttaaaaaaaaaaagtcttctaatcagaagccactgattttataataaataacacttgttttgaa

SEQ ID NO: 276895 - DNA, 2806 bp, Homo sapiens
ccacgcgtccggccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcagggttgtcccaggtcctgctgcgaggaggcggccaggtcctgctcggctggacactccattacttcccgtttttcctgatgggccgggtcctctacttccaccactacttcccagccatgctcttctcaagcatgttgacaggcattctgtgggacaccctcctgcggctctgtgcctggggcttggcctcatggcccctggcgaggggcatacatgtggcgggaatcctgagcctgctcctgggaactgcctacagcttctacctcttccaccctctggcttacgggatggttggtcccctggcccaggacccccaaagtccaatggcaggactaaggtggctggactcatgggacttttgaggccactgcaaagattccagcctgggtccaggaacttcccaggagagccagctgggaagcagtactggaccatccggccatgaggaagctgcctaaggagcccgaagaattctgctgctcaccaggacccagctctgggagtgcagctggaatggaacccagcattggagagagccgggagagagccgcagctccgtccacagcaccacggagaggacagcgcctcttgggctgctccctcgtgcacagcgcaggggaggatgggtgccagagggtgggagtgggtgcgcgtgtgtgtatgtgagggcatgttgtccatatccctgtggaatacagaccgtgtaactgg

SEQ ID NO: 276896 - DNA, 2317 bp, Homo sapiens
ccacgcgtccggccgcctcctagcggcccgggccgcgaccacgctgcccgccccgccccgagcccggggccccgcgctccgctgcagtgaagggcgttgcatttcccggggtaccccgagctgccctcttgtgactccttggcggggcggctggtcagacaaagtgtgcctccgggccggagggcgacccagaggagggggaagatgccgccggccacgggcggaggcctggcagagtccgagctgcgtccccggaggggccgctgtggcccccaggctgctagggccgcaggccgggacgtggccgctgaggctgtggcgcgaagccccaaacggcctgcttggggctcacggcgcttcgaggcggtcggctggtgggccctgctggccttggtgacgctgctgtccttcgccacccgcttccaccgcttggacgagccgccgcacatctgttgggatgagactcactttggaaaaatgggaagttactatatcaaccgtacatttttctttgatgtgcacccgcccctgggaaagatgctgataggtcttgctggctacctgagtggatatgatggtacctttttgttccagaagcctggggataaatatgagcatcacagctacatgggaatgagaggattctgtgcattccttggctcctggctggtcccctttgcctacctcactgtactggatctgtccaagtccctctcggcagcactgctcacagctgccctcctcacctttgacacgggatgcctcactctgtcccagtacatcctccttgaccccatcctgatgttcttcatcatggctgccatgctgagcatggtcaagtacaactcttgcgccgacaggcccttctctgccccctggtggttctggctcagcctgactggcgttagtcttgctggtgctttaggggtcaagtttgttggcctctttatcatccttcaagtggggctgaacaccattgcagacctttggtacctgttcggagacctcagtctttcattggtgactgtgggaaaacacctgactgctcgtgtcctgtgcctcatagtgctgcccctggctctctatacagccacctttgctgttcacttcatggtgctgagtaaaagtggccctggtgacggtttcttcagttctgccttccaggcccggctttcagggaacaacctgcacaatgcttccatccctgaacacctggcctacggctctgtgatcactgtgaagaacctccggatggccatcggctatctgcactcccacaggcacctctaccccgagggcattggtgcccgtcagcagcaggtcaccacctatttgcacaaggactacaacaacctgtggattatcaagaaacataacacaaactcagatcccctagacccttccttcccagtggagtttgtaagacatggagacattattcgactagaacacaaagaatgtccacttaaaaaaatctggcgatgggagcagaaagaaacttcccggaacttgcacagtcactatcatgaggcccccatgacccggaagcactatcaggtcaccggctatggcataaatggaacaggggactcaaatgatttctggcggattgaggtcgtaaacagaaaatttggaaaccggatcaaagtgctgagaagtcgaattcgcttcatccatttggtcacaggttgtgtcctgggctcctcgggaaaggttctgcccaagtggggctgggagcagttggaagttacttgcaccccatacctgaaagaaaccctcaactccatctggaatgtggaggaccatatcaatcccaagttgccaaacatcagcctggatgtgctacagcccagttttcctgagatcttgctggaatcccacatggtcatgatccgggggaacagtggcctcaaacccaaggacaatgagttcacgtccaaaccctggcactggcctatcaactatcagggcctacgcttctcaggggtcaatgacacagatttccgagtctatctgcttggcaacccggtggtttggtggctgaatctgttgagcatcgccctctacctcctctcagggagcatcattgctgtagccatgcagagaggggcacggctgccagcggaggttgcaggtcaggtcctctgggctctccctcccctgacctggcggcagcagggcacctgcgcccctggggagggccggctgcctgctgatgggccatcctttgcgtttacaacccaaacttcccttatccttgcttttgaaaggtaacaaccccagtacccgtgctgggtaacaacactttacttcctcc

SEQ ID NO: 276897 - DNA, 479 bp, Homo sapiens
cactcatgaccaccttgctcccaccttgctcccaccttgctccccagttctcagatggtgccttcctgggtgtaaccacgctgaaacacgtccatttggagaacaaccgcttgaaccagctaccctccaacttccccttcgacagcctggagaccctcgcccttaccaataacccctggaagtgtacctgccagctccggggccttcggcggtaagaacacttccatgtcactcccagagcccaccctcatgtgatagaggcacattagccctgcactaagacatgttggacatgcatcctagatctgctacctaataagcatgggaccctgggagcctcagtttccccatttgtaaaatgaagatgacagcttcagactatcctgtggccaagtcaatcctggccccatagttcactgcccttccccccagcactcccaccttcttccccagccccagcaagtttctgtctctccagg

SEQ ID NO: 276898 - DNA, 612 bp, Homo sapiens
cttaccaataacccctggaagtgtacctgccagctccggggccttcggcggtaagaacacttccatgtcactcccagagcccaccctcatgtgatagaggcacattagccctgcactaagacatgttggacatgcatcctagatctgctacctaataagcatgggaccctgggagcctcagtttccccatttgtaaaatgaagatgacagcttcagactatcctgtggccaagtcaatcctggccccatagttcactgcccttccccccagcactcccaccttcttccccagccccagcaagtttctgtctctccaggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggtgggggccaggtaaacaggtcccctatgtccctctttggtgattccagcaagtgagctggtatcttccaggataccccctggccctggagggtcaggcagaccctccatttttacagagagaggaggggacgactgggtcccctgttg

SEQ ID NO: 276899 - DNA, 1806 bp, Homo sapiens
tcgatgctccacgtaggagctggctcggctgccggctgcggtcagggccaccgtataaagagggcggcagacccgagcgcctaggactcgccgctgcccgcgccccgccgccgctgctgcccccagccccggccccaggcgtcccagccatggtccgcccaatgctcttgctcagcctcggcctcctggctggtctgctgccggcgctggccgcctgcccccagaactgccactgccacagcgacctgcagcacgtcatctgcgacaaggtggggctgcagaagatccccaaggtgtcagagaagaccaagctgctcaacctacagcgcaacaacttcccggtgctggctgccaattcgttccgggccatgccgaacctcgtgtcattgcacctgcagcactgccagatccgcgaggtggccgccggtgccttccgcggcctcaagcaacttatctacttgtacctgtcccataacgacatccgcgtgctgcgcgcaggtgccttcgacgacctgaccgagctgacctacctctacctggaccacaacaaggtcactgagctgccccgggggttgctctccccgctggtcaacctcttcatcttgcagctcaacaacaacaagatccgtgagctgcgcgcaggcgccttccagggagccaaggacctgcgctggctctacctgtcggaaaacgcgttgagctccctgcagcccggggccctggacgacgtggagaacctcgccaaattccacgtggacaggaaccagctgtccagctacccctcagctgccctgagcaagctacgggtggtggaggagctgaagctgtcccacaaccccctgaaaagcatcccggacaatgccttccagtcctttggcagatacctggagaccctctggctggacaacaccaacctggagaagttctcagatggtgccttcctgggtgtaaccacgctgaaacacgtccatttggagaacaaccgcttgaaccagctaccctccaacttccccttcgacagcctggagaccctcgcccttaccaataacccctggaagtgtacctgccagctccggggccttcggcggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggtgggggccaggttctgacccagccagtcctggtgactggcctctgccttccaccggagagactactgaccttctcacctccacccataccttctccccacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagacacccccccccaagtcaatcagaaccacaacaggttggtcatcaggatggccaccctcccaggatcatccttcctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtatgtatgtattaaatttactc

SEQ ID NO: 276900 - DNA, 690 bp, Homo sapiens
tgagtgtgaagtgttgaacagcggctcagggaggccaaccagggtccagcaaaccccgtccctgctgcctccattggtccagagctggtacccgcagccagcatgacactcacccagtcccagacattgtgggtcaacagagagaaattcagatagctaagagaatggaagcggacaaaggaggcacaggaggattccatgccagagtctgaattggtcacccccattcaggctctgcctgaggaaaggagaatggggtccgggcacagtcagctggatggagcgtctgaagacggcttgcaccagagccctccgtggctgaagggagaagctagggggtgagtcagccccagggcttgatggaacagacaggaactagatgatctaggaagggagaaatgaggctgagcaggagacagcccaggctccctggctgccactacctaatctgtcccccttcacacacatcccacacacagtgtttagacagagcagcagagaagaaacagacatcctggatcccacagggagcaggctggggctgggaacaggaggtctgtttattcctggaagtcacatatcagaagggtcccacacccacttctgtccaggccccaggctgaactctcccagagcctgtgacttctgcccgaccagatcccgtggttctgaggaccggccctggaaccc

SEQ ID NO: 276901 - DNA, 692 bp, Homo sapiens
tatacaaaaaccttttattgactgtatttcttctccccataacctggaacccagccagcatctatggcttcctgctgtctgattcttgaaagtggggccttgggaacatgtttggaggctatggaaggtggggttttctgagtctactgggtagactcagacaatcaatccaaaaactttagaaagggctaagctccacagcactgatctcaaccctgggtgctcattagaatcaactggggagcttttaatagctactgatgcctgggacccaccctagacaattaaattgaatctctggggcagagactcaggcatcactgtggtttaaagcatcccagactggaagccggaacctttacggaagagcctgaagcagtcagggcttggactagcatccattttagcgactgtccttgtaacagtgggtactgcgcttctctcagcagtagcaatgtcttactctctccaatccatcctcattatgacacaaaaaagcacaggcaaaaactagccaacattagcaggtcattaacctatcacagagaggtaactagtcctgtgccaggatctaaagcaggctctgcaggagagcacacagaattagagggcaacttagtgtcagtcagagaagacgaagctgaactggctgcttaacagtcacacatgcaccagctgggcaaccaaggggg

SEQ ID NO: 276902 - DNA, 406 bp, Homo sapiens
tatacaaaaaccttttattgactgtatttcttctccccataacctggaacccagccagcatctatggcttcctgctgtctgattcttgaaagtggggccttgggaacatgtttggaggctatggaaggtgggaatctcctcacccaccggctatgcaggttgaaggaagctttcttgcctggctgaagctacggcagcttcccagggtagcccctcaagtctagaggacccatcccccactaaatgggtgtgaggaagagatgatgcatctttcagaggctttgtcactcactgctcctatcccactccagactgaggccctagagctgaaccagtctctcctgtggagatggggcccagcagcgaggggagggggttagaggtgagtgtgtgcagcagctctggg

SEQ ID NO: 276903 - DNA, 2596 bp, Homo sapiens
gtaatccgagctactcaggagctgaggcagaagaaccccttgaacccgggaggcggaggtttcagtgagccgagatcgcgccactgcactcctgcctgggacacaatgcgtgactccgtctcaaaataaaaataatcgttagatcaatgagtgcgggaattctaaaaggggtctggaactctcgcaaggttgtggatcactacacctgaagcttaaggggaatgaaatcggtgagaaatgagggtcctacagcccgggccgaagtgacaggtccacccctagtgactccaacaggtgaggagcacccccgacccgcctccctcggcactaaagcgggacgatagggcgcagggctccacccggaagcctcgccataatgtccgcgggcgggccggggcgaggagaaggtgggaagccgtggccgcaggttccgggaggggtcagccgtcctgggcaaggtcaggcccgacttccccggctgaggccgctgcgacccggccctgcaggctccaggcggcagagcaaggggagcgccctagcggggccccagggtccgggccgcctcacctgcaggtgaacttgagggcgaggagcagcgcgcagccgagcgccacggccccgcagagcagctcgggccgctggcgcgccatgaggaaggcgccacgcagcccgcgacggagccggcctgccgaggacgctgtggccagggtcgggctcgagctgaggcagtctgagcccgcggagccgccgccgccccctccctcgtcctcggcgtcctcgctgctgctgctgccgccgccgcggcctccgcattccgacattacatgctcccagtcgccggctttataccgccgccgccgcctcgggcccgaaggcccggcccggcccgttgctccccaatcccgcagctcgccgcacccgctaacccggacgctccacgtcagccgcgccgccgccgcggggtccgccccacctcactccccagagcacgcagctccgcccaccgctcacggagtccgggcgggcaccgacaccgcccaaatccccgcccccaacgggccacgccctgcaccctacgtaaatgcacggaagccttccccgcccgcagcccagtcttggccccaccggtcacgaccccgctcacggagtctgcgcaggcgccgtcgcggggcgtggagaagctgctcccttgggataaggcccgcggggaatacttggaaccttgacaccgctgtagtctgctctcgccgcgctgggttttaggagccgtaacgacaataatcgtgtccaccattctcactacaggccccgaagcacgtaggtgccgttttttatcccaacttaactgaagaaaaaaaacacggccgggcgcggtggctcaagcctgtaatcccagcacgttgggaggccaaggcgggcagattacatgagaccaggcgttcaagaccagcctggccaacatggtgaaacctcgtctctactaaaaatacaaatatattagccgggcgtggtggcgggcgcctgtaatcctagctgcttgggaggctgaggcagagaattgcttgaaccctggaggcggaggttgcagtgagtggagatggcgccactgcactcccgtctgggggagagagagagagagactcttgtctcaaaaaaaaaaaaaaggacttgtcctccaatgtcaataacaacaaactagacaaataaaacttcgagggcattaaggcaatatggtgttatgccacaaacagaaggcacagctaacggccagtagctgagacgccacctctgccacaggtcagctatgtgacccacgtgcaaatctcatcacttcctgtctggttctgcttctgtggatgtagaatggggcaatcaatggctgtcttgctcaattggccagacatttaatgtgtcagccacccaggcccaacatgttgtgagttcgtgtacaccgaccattttgctatttcttttctatatgtcacttttttttttttggttgttttttgatacagggtcttgtgtcacccaggctggagtgcaatggcgcaatcatagcacactgaagccttgacaaccccagctcaagcgatccacccccctcagcctcccaagtagtaggcaacacagatgtgtgcgactacgcccagctaatttttttttttttgtggagacaaggtctctccatgttgcctaggctggtcttgaactcctgggctcaagcgatcttcccccttcgacctcccaaagcgttaggattatgtaaaagcatgagtcactgcgcccacctgtcacatctttttgtttcttctatactgccttattttgtagaaagtagctattttctcgtataacattaattcctttatttttaacttgtccctcatctctgttttgtgttattattacccttattatctatgttacaaacccaaccatacagtgctaatcttgttttaaaaagctgagaaaaaatatatagttacagagtttttttaaccttctaatttgccacttatacttctgattgattcctttgtgtagattagagttacacaatttattgctaaagaaaataaatatgatcaaaagtcat

SEQ ID NO: 276904 - DNA, 6022 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctac

SEQ ID NO: 276905 - DNA, 2062 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtgtgagtatctcttcctagctcaaggacccagacccctgtccctttctctgcccaggagagatgtataagtatcatgaccaccaggactggtctcacgagtggccacagcagacagtgcctgaaatgcccccatgatcaccttcccgcgatggcccggggcagagatggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctac

SEQ ID NO: 276906 - DNA, 7062 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctactgccttagtctacccactgtccttttgttatgaggtagaggatctcatgacaccatacacacaaacccatcattgcctgtgaatgcacgtagggccagaattccccagttcccgctcctctgagggttgatactgctgggaatgccaaccactccacaagcagagggaagccccctcaggcctgcaggaggagccgcagcagtgtgtccaattcaaaccagcagcaaagagcctgacattttcccatccatctatgaggaaagccatctcacagaacatggacataggcaacttgctctcccacaccaagggatgggaatctctcctacctatagtcatccctgcactcctgactttactccaggacccagggtccaactaatggcagagcccctcttggttccttcaaacaagaaaagcaatacctacggactggtgtacacttccatccttggttataacaggaatgttatcaagctgtcagaacaggatgaagtgctcccagtggatatccatcagggagggttagggacactcgtggcagcctgtctagcagcctgggctctctgaaagtccctaacttcctgaggggtacgcaaatactgttctatttcactatcagaaatgttctcatctccagtgacagtggagacagggggtacagggcagatccgcttcggggacttcaacatgcagggtggcaagagaagggcaggactggccggccgcttcccctggggtaaacctaaggaattatttcccacctccccttctccttgcccctgtccccaccccggtggctccttctctcgggtctccacttctgctgtcccatcccgaaaggcagagcggaccagtgactggcggtgctggagaaggtcaccgatgtgcttcaccacagaccgtttgtcaagtctcagaactcgtaaccaggccagctgctcagccatccgcagcagcacagccagcagctcctgcaggcgggaggacgccgggtagggcaggtccacatttgccaatttacaaaatcgggcaaggga

SEQ ID NO: 276907 - DNA, 6772 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctactgccttagtctacccactgtccttttgttatgaggtagaggatctcatgacaccatacacacaaacccatcattgcctgtgaatgcacgtagggccagaattccccagttcccgctcctctgagggttgatactgctgggaatgccaaccactccacaagcagagggaagccccctcaggcctgcaggaggagccgcagcagtgtgtccaattcaaaccagcagcaaagagcctgacattttcccatccatctatgaggaaagccatctcacagaacatggacataggcaacttgctctcccacaccaagggatgggaatctctcctacctatagtcatccctgcactcctgactttactccaggacccagggtccaactaatggcagagcccctcttggttccttcaaacaagaaaagcaatacctacggactggtgtacacttccatccttggttataacaggaatgttatcaagctgtcagaacaggatgaagtgctcccagtggatatccatcagggagggttagggacactcgtggcagcctgtctagcagcctgggctctctgaaagtccctaacttcctgaggggtacgcaaatactgttctatttcactatcagaaatgttctcatctccagtgacagtggagacagggggtacaggcatctcacaaccggccccaaagccgcggaagccttcagagactcctgggtctgcaacagcaaccgtgaggcagcaagaagtagga

SEQ ID NO: 276908 - DNA, 6954 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctactgccttagtctacccactgtccttttgttatgaggtagaggatctcatgacaccatacacacaaacccatcattgcctgtgaatgcacgtagggccagaattccccagttcccgctcctctgagggttgatactgctgggaatgccaaccactccacaagcagagggaagccccctcaggcctgcaggaggagccgcagcagtgtgtccaattcaaaccagcagcaaagagcctgacattttcccatccatctatgaggaaagccatctcacagaacatggacataggcaacttgctctcccacaccaagggatgggaatctctcctacctatagtcatccctgcactcctgactttactccaggacccagggtccaactaatggcagagcccctcttggttccttcaaacaagaaaagcaatacctacggactggtgtacacttccatccttggttataacaggaatgttatcaagctgtcagaacaggatgaagtgctcccagtggatatccatcagggagggttagggacactcgtggcagcctgtctagcagcctgggctctctgaaagtccctaacttcctgaggggtacgcaaatactgttctatttcactatcagaaatgttctcatctccagtgacagtggagacagggggtacagggcagatccgcttcggggacttcaacatgcagggtggcaagagaagggcaggactggccggccgcttcccctggggtaaacctaaggaattatttcccacctccccttctccttgcccctgtccccaccccggtggctccttctctcgggtctccacttctgctgtcccatcccgaaaggcagagcggaccagtgactggcggtgctggagaaggtcaccgatgtgcttcaccacagaccgtttgtcaagtctcagaactcgtaaccaggccagctgctcagccatccgcagcagcacagccagcagctcctgcaggcgggaggacgccgggtagggcaggtccacatttgccaatttacaaaatcgggcaaggga

SEQ ID NO: 276909 - DNA, 6683 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctactgccttagtctacccactgtccttttgttatgaggtagaggatctcatgacaccatacacacaaacccatcattgcctgtgaatgcacgtagggccagaattccccagttcccgctcctctgagggttgatactgctgggaatgccaaccactccacaagcagagggaagccccccatctcacagaacatggacataggcaacttgctctcccacaccaagggatgggaatctctcctacctatagtcatccctgcactcctgactttactccaggacccagggtccaactaatggcagagcccctcttggttccttcaaacaagaaaagcaatacctacggactggtgtacacttccatccttggttataacaggaatgttatcaagctgtcagaacaggatgaagtgctcccagtggatatccatcagggagggttagggacactcgtggcagcctgtctagcagcctgggctctctgaaagtccctaacttcctgaggggtacgcaaatactgttctatttcactatcagaaatgttctcatctccagtgacagtggagacagggggtacaggcatctcacaaccggccccaaagccgcggaagccttcagagactcctgggtctgcaacagcaaccgtgaggcagcaagaagtagga

SEQ ID NO: 276910 - DNA, 5914 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctac

SEQ ID NO: 276911 - DNA, 5640 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctac

SEQ ID NO: 276912 - DNA, 3184 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtaagcaggagaaggggctctgggggtggtgctccgagatgagtgctggcacctaggcatagagtggggtgatgcgctggaagaaaaaggctggtgctcataggccgtggctccatggcttcctctgtggcagccttggaaggcagggatggtgggtcgtggagagtcgtcagagttggggaggtgttcagggaggtttccagagtgcagggaggtttccagaagtgcagggataggggtcctagaggccggaggggatgcagtcattagtgtcagtgagtttgaat

SEQ ID NO: 276913 - DNA, 1433 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcggtgagcaagtccccccagctacacatctcccagggaccctgcctctccaccaacccagggcccagacacgagcctcccctcagacccacaggtttttacctttgtattgcaatttgcaaaagaccacgacactgagtcctgctcttgcatttagggagaccttatctttatgtataaatcaccatctgagaagtgctgcccagcacaaaaaggcttttctgtgctgtctttcattacaggtttgcaacagctctcccacaaaaagaatcacatttactatcccagcgaccctcctgcgggccagtgttatcctccctcctagcctctat

SEQ ID NO: 276914 - DNA, 5932 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccgctgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctac

SEQ ID NO: 276915 - DNA, 7075 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttcccccaggtgcaccctccccaagtactcccaccccgcctactgtccatgcggcctcactggggccatcagcctcaccagcaaagcagagatgggagggagggaatgaaagtgccaaagaaaacatgtttttaagaactcgggttttatacaatagaatgttttctagcagatgcctcttgttttaatatattaaaattttgcaaagccctttgagctactgccttagtctacccactgtccttttgttatgaggtagaggatctcatgacaccatacacacaaacccatcattgcctgtgaatgcacgtagggccagaattccccagttcccgctcctctgagggttgatactgctgggaatgccaaccactccacaagcagagggaagccccctcaggcctgcaggaggagccgcagcagtgtgtccaattcaaaccagcagcaaagagcctgacattttcccatccatctatgaggaaagccatctcacagaacatggacataggcaacttgctctcccacaccaagggatgggaatctctcctacctatagtcatccctgcactcctgactttactccaggacccagggtccaactaatggcagagcccctcttggttccttcaaacaagaaaagcaatacctacggactggtgtacacttccatccttggttataacaggaatgttatcaagctgtcagaacaggatgaagtgctcccagtggatatccatcagggagggttagggacactcgtggcagcctgtctagcagcctgggctctctgaaagtccctaacttcctgaggggtacgcaaatactgttctatttcactatcagaaatgttctcatctccagtgacagtggagacagggggtacagggcagatccgcttcggggacttcaacatgcagggtggcaagagaagggcaggactggccggccgcttcccctggggtaaacctaaggaattatttcccacctccccttctccttgcccctgtccccaccccggtggctccttctctcgggtctccacttctgctgtcccatcccgaaaggcagagcggaccagtgactggcggtgctggagaaggtcaccgatgtgcttcaccacagaccgtttgtcaagtctcagaactcgtaaccaggccagctgctcagccatccgcagcagcacagccagcagctcctgcaggcgggaggacgccgggtagggcaggtccacatttgccaatttacaaaatcgggcaaggga

SEQ ID NO: 276916 - DNA, 5974 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcaga

SEQ ID NO: 276917 - DNA, 6717 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctactgccttagtctacccactgtccttttgttatgaggtagaggatctcatgacaccatacacacaaacccatcattgcctgtgaatgcacgtagggccagaattccccagttcccgctcctctgagggttgatactgctgggaatgccaaccactccacaagcagagggaagccccggagggttagggacactcgtggcagcctgtctagcagcctgggctctctgaaagtccctaacttcctgaggggtacgcaaatactgttctatttcactatcagaaatgttctcatctccagtgacagtggagacagggggtacagggcagatccgcttcggggacttcaacatgcagggtggcaagagaagggcaggactggccggccgcttcccctggggtaaacctaaggaattatttcccacctccccttctccttgcccctgtccccaccccggtggctccttctctcgggtctccacttctgctgtcccatcccgaaaggcagagcggaccagtgactggcggtgctggagaaggtcaccgatgtgcttcaccacagaccgtttgtcaagtctcagaactcgtaaccaggccagctgctcagccatccgcagcagcacagccagcagctcctgcaggcgggaggacgccgggtagggcaggtccacatttgccaatttacaaaatcgggcaaggga

SEQ ID NO: 276918 - DNA, 6032 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccagccccaaagaggcagattgctgatcctgcccctctatgcgttagccatgaaatgttttatgctaattcatagggctaacattgggatagggtgcaatggcctgatttttagatccatgatcagtcatcgtttttttcaaaaataggatttttaccgtttccctctctgttcagtgtagtctaatggtgtttaacccttttcattcaaaatttc

SEQ ID NO: 276919 - DNA, 5474 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtttcgtcttatgtaaaaccatccctattttttgttcttcattttcacagtttttgtatctctacttaatgttataccagttttccgacttttatgagctaatgccaatccc

SEQ ID NO: 276920 - DNA, 1902 bp, Homo sapiens
atccatggcacggagcggcggcggcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtgatgccagcaacagcaggtgctcgtccaccagcatcaggtaccgagccgatta

SEQ ID NO: 276921 - DNA, 4110 bp, Homo sapiens
ttcgtctgagacgaaggcgcaggctcggggctccctgtcgccggtggctgggtggcgtccccccaccacgcccccacccctctactcacccaagaggagcctctccaccgagccctgcatcctgctgccctggcagccagtccagctaggcactggcccagttcactgtacctggacttacccactggcaccctccggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgggaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtaatacacctgccatgctccctctccacactgtccctcctttcatttcccaatctttgctcccttcccctgtgtcatatccctgccctctggccacttgtggatggagaggtattgagggaccaggatgtgcctgctgagccagtctcctccctgccctaaggtgggacagggctggctaatcgagaaaaatgatgtaattgattattgatgtctgcccaggtgtgggagtggggagtagtggcaccagtgccaaagattggccatttctgctaggtatacagtgatgtctggcaccccagagaagatcctagagcttctgttggaggccatgggaccagattccagtgctcatgacccaacaggtgggtggccctgcttggatgttgtggttcccttgactggtgcccaccttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaact

SEQ ID NO: 276922 - DNA, 2850 bp, Homo sapiens
tccggtcggtaccgacgctctctctgtggatcatgagttgagcatgggatgtggcctgttctccaggatgtggaggcaaagaccatgcggctggaagaacatggcaaagtggtgctggtgctggagagagcctctcagggcgccggcccttcccgacccccaaccccaggcaggaaccggtaatacacctgccatgctccctctccacactgtccctcctttcatttcccaatctttgctcccttcccctgtgtcatatccctgccctctggccacttgtggatggagaggtattgagggaccaggatgtgcctgctgagccagtctcctccctgccctaaggtgggacagggctggctaatcgagaaaaatgatgtaattgattattgatgtctgcccaggtgtgggagtggggagtagtggcaccagtgccaaagattggccatttctgctaggtatacagtgatgtctggcaccccagagaagatcctagagcttctgttggaggccatgggaccagattccagtgctcatgacccaacaggtgggtggccctgcttggatgttgtggttcccttgactggtgcccaccttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaact

SEQ ID NO: 276923 - DNA, 2174 bp, Homo sapiens
gccaccatataggctaggtacgaggctggtgtgaatcggccgagggtgtccttatggtgccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaact

SEQ ID NO: 276924 - DNA, 1870 bp, Homo sapiens
gtcttattgtctccattttaccagggaagaaagtgaggctgagggaggctcagaccctgcccaggttcttcctgactcactgagaatctttcctcatcctcttggatgtgcttccctgggctgcgtggctgcgtgggcacatgcacctgtgtattctgagcaccacccaggacttcaaccccgctactaggagaaacaacctctcagcctcccaaacagcacctccaccctggcatccagctggtccccggcctccctcccttcccccacccagtccgcctctgctgtctttgcagatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccagcctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaact

SEQ ID NO: 276925 - DNA, 3866 bp, Homo sapiens
ttcgtctgagacgaaggcgcaggctcggggctccctgtcgccggtggctgggtggcgtccccccaccacgcccccacccctctactcacccaagaggagcctctccaccgagccctgcatcctgctgccctggcagccagtccagctaggcactggcccagttcactgtacctggacttacccactggcaccctccggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgggaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaact

SEQ ID NO: 276926 - DNA, 3118 bp, Homo sapiens
tttcctctcctcccccacgcctgggcctctgccccccagtgaaacacgactgggccttccaggaccgagatgcccaattctaccggttccccgggcccgagcccgagcccgtgggaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaact

SEQ ID NO: 276927 - DNA, 3103 bp, Homo sapiens
ttcgtctgagacgaaggcgcaggctcggggctccctgtcgccggtggctgggtggcgtccccccaccacgcccccacccctctactcacccaagaggagcctctccaccgagccctgcatcctgctgccctggcagccagtccagctaggcactggcccagttcactgtacctggacttacccactggcaccctccggatccccttatcaaagctgatgggggtcgctggggaccccccagccttttgctagagcctgcacggctgtgcgagcttgaaaagaaacatgaaggtgggctggccaggtgagagctgctggcaggtgggcctggctgtggaggatagcccagctctgggagcaccgcgggtgggagccctccctgacgtggtgccggaggggacactactcaacatggtgttgagaaggatgcaccggccccgaagctgctcctaccagctgctgctggagcaccagcgtccgagctgcatccaggggctgcgctggacaccactcaccaacagcgaggagtccctggatttcagcgagagcctggagcaggcctccacagagcgggtgctcagggctgggaggcagctgcatcggcatctgctggccacctgcccaaacctcatccgagaccggaagtaccaccttaggctctatcggcagtgctgctctggccgggagctggtggatgggatcttggccctgggacttggggtccattcccggagccaagttgtgggaatctgccaggtgctgctggatgaaggtgccctctgccatgtgaaacacgactgggccttccaggaccgagatgcccaattctaccggttccccgggcccgagcccgagcccgtgggaactcatgagatggaggaggagttggccgaagctgtggccctgctctcccagcgggggcctgacgccctgctcactgtggcacttcgaaagcccccaggtcagcgcacggatgaagagctggacctcatctttgaggagctgctgcacatcaaggctgtggcccacctctccaactcggtgaagcgagaattagcggctgttctgctctttgaaccacacagcaaggcagggaccgtgttgttcagccagggggacaagggcacttcgtggtacattatctggaagggatctgtcaacgtggtgacccatggcaaggggctggtgaccaccctgcatgagggagatgattttggacagctggctctggtgaatgatgcaccccgggcagccaccatcatcctgcgagaagacaactgtcatttcctgcgtgtggacaagcaggacttcaaccgtatcatcaaggatgtggaggcaaagaccatgcggctggaagaacatggcaaagtggtgctggtgctggagagagcctctcagggcgccggcccttcccgacccccaaccccaggcaggaaccggtatacagtgatgtctggcaccccagagaagatcctagagcttctgttggaggccatgggaccagattccagtgctcatgacccaacagagacattcctcagcgacttcctcctgacccacagggtcttcatgcccagcgcccaactctgcgctgcccttctgcaccacttccatgtggagcctgcgggtggcagcgagcaggagcgcagcacctacgtctgcaacaagaggcagcagatcttgcggctggtcagccagtgggtggccctgtatggctccatgctccacactgaccctgtggccaccagcttcctccagaaactctcagacctggtgggcagggacacccgactcagcaacctgctgagggagcagtggccagagaggcggcgatgccacaggttggagaatggctgtgggaatgcatctcctcagatgaaggcccggaacttgcctgtttggctccccaaccaggacgagccccttcctggcagcagctgtgccatccaagttggggataaagtcccctatgacatctgccggccagaccactcagtgttgaccctgcagctgcctgtgacagcctccgtgagagaggtgatggcagcgttggcccaggaggatggctggaccaaggggcaggtgctggtgaaggtcaattctgcaggtgatgccattggcctgcagccagatgcccgtggtgtggccacatctctggggctcaatgagcgtctctttgttgtcaacccacaggaagtgcatgagctgatcccacaccctgaccagctggggcccactgtgggctctgctgaggggctggacctggtgagtgccaaggacctggcaggccagctgacggaccacgactggagcctcttcaacagtatccaccaggtggagctgatccactatgtgctgggcccccagcatctgcgggatgtcaccaccgccaacctggagcgcttcatgcgccgcttcaatgagctgcagtactgggtggccaccgagctgtgtctctgccccgtgcccggcccccgggcccagctgctcaggaagttcattaagctggcggcccacctcaaggagcagaagaatctcaattccttctttgccgtcatgtttggcctcagcaactcggccatcagccgcctagcccacacctgggagcggctgcctcacaaagtccggaagctgtactccgccctcgagaggctgctggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcggctctggccatcattctcatcttctcaaagttgatgagattctccactagtgtgtggtttccctcatgaatgaaggtcatgcctttgagaagaaggggcatgaaggggatgtcgcacc

SEQ ID NO: 276928 - DNA, 1707 bp, Homo sapiens
ctagaccagtagaagaggcgaggatagagttgggggtggaacctcccacctccaggaacttttgaggattttgagggttttgactattctggagagaagcagagaagaggtacttcatcagcatagcctgggagctcttgagagaaaatccacctcgtggggctcaagggattcaaaggagtttactctgcagagagagagagggagggacacagaaagagacagggatagaaagggacagagaggtgacagtgacagacttttccaagaaacctggggcccctgtgactaactgctgtgaattttctcagtgctaatgggaggttggaagccccgtgttcgcctgtgacagagcctgggtgagacctggggctgaggagaggctgagttggggcctctgcacctgctgtgggatgggcatgtggcccctccttggttgggtggggtctgtggtggcttatggtgtgtgcaaccccctcagtgtggcttcttcccctaggatccctcatggaaccaccgggtataccgactggccctcgccaagctctcccctcctgtcatccccttcatgccccttcttctcaaagacatgaccttcattcatgagggaaaccacacactagtggagaatctcatcaactttgagaagatgagaatgatggccagagccgcgcggatgctgcaccactgccgaagccacaaccctgtgcctctctcaccactcagaagccgagtttcccacctccacgaggacagccaggtggcgaggatttccacatgctcggagcagtccctgagcacccggagtccagccagcacctgggcttatgtccagcagctgaaggtcattgacaaccagcgggaactctcccgcctctcccgagagctggagccatgaggaggggctgggactggagctggagcaggcacttgcagccgggaaagccagggtgtgccgggccaagatactcacaggctggccacagctgggcaaggctctccgtggagtggactcgagtccctggagcaggcagtgtggaggcagccatcccctgtgatgactggcagctaaggaggacctcggagtggacccgagccaggaataacgaatgacccaaggccaaggaagggaggacagagaggccccaggagtgggtggagagtggagtgcgctgggacgttgtgtgcaatagagaggtctccacaccagatgtcttccagattctgtgcctctggctttgttgtccagccaggcctgcagtttattttcacagtggacagagagagagagagaggctgcatgtgtgtaccgtgtgtggcaagggcagggccttggcctggggcaggggccccctgctttctttccacagctttcttccaacagcaggcagtggggctgcgggcctgtgcggtggtccctgaggagctttattgttactgtcaacatagtagtatgttccaggccagcccagagtgggcgtggcagggaggctgaggccccgccctctgggaaggagctgtggaggagaagcagccccatgctgggcacgggccagactgggtccaagatcctgatgccacccagatgtgcctccagggctctggccaaagggcgggctggagcctggagcccctgtcagcagccagccagggtgaccatcagctccccgtggtggtccaataggactttacagtccagatgcaact

SEQ ID NO: 276929 - DNA, 1398 bp, Homo sapiens
atggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaagtgaatgcataaaaatacaaccaactgacatccaacctgacatattcagctatttgttgcacattatgtacacggggaaagggccaaaacagattgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccacccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagaggtgacaggccccacttttactgaaaacagtgtcaaaatacacttatgccattactgtggggaacgttttgattcccgtagtaacctaaggcaacatctccatacacatgtgtctggatccctgccattcggtgtccctgcttccattctggaaagtaatgaccttggtgaagtgcatccccttaatgaaaacagcgaggcccttgaatgccgcaggctcagctccttcattgttaaggagaatgaacagcagccagaccacaccaaccggggtaccacagagcctttgcagatcagtcaagtatctttgatctccaaagacacagagccagtagaattaaactgtaatttttctttttcaaggaaaagaaaaatgagctgtaccatctgtggtcataaattccctcgaaagagccaattgttggaacacatgtatacacacaaaggtaaatcttacagatataaccgatgccaaaggtttggtaatgcattggcccagagatttcagccatactgtgacagctggtctgatgtctccctgaaaagttctcgcttgtcacaagaacacttagacttgccttgtgccttagagtcagagctcacacaagaaaatgtggatactatcctagttgagtagcagcttctctttcagaatttttataccaattctgaaaaagaaaatttgcgtggcatttttaattcataaattattttcctcctcaagttt

SEQ ID NO: 276930 - DNA, 580 bp, Homo sapiens
cagtgatctggatctctgacagcttcttctccaggtctctgagcgtctcctgctttaaggtgatttcctccttccgcacctcaactggcctcatcattttctccatcctcgcccattcagcccactcggccgcctcctcccgctcggcctcctcctcctcctccaccttctccctcaggacctccattctggagcgtctctgggtgtctggagatggaatgtctctgtggggaaggatccctggagatcccatccatgtcatgtggacatcatatcacatgattctgcccttctggtcgcagctgattggaccagagatggacgatggacacccaacttgcaagacaacacagcccatcacctccctggtgcaggggcctcaccttgcaaggagttgaaaagtgcaaagatgtagacggtggagaggcccaacggggtgaagatggccaacccccatgtcacacccaccaggctcgagaggcccagcaggggggaatctgggagaacgaaccacaggactctgcactatttttgcatctttctgttttatctcaaaataaaatccttctcaatcctgaaa

SEQ ID NO: 276931 - DNA, 577 bp, Homo sapiens
gaagagactgactagtcctcccaaagtacttgtgtccgggtggtggactggattcgctgcggagccctggaagctgcctttccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacacggtgtgcctgggacacagagctggcttcccaagaggacctggtgaatacccacgaggcgtattcatctgcatgcatgagtcctgacttctttcagaagctctctggagaccttgggcagagtagcttcactagcaacagtgctgaggacgccaggaagtggagatgttgtccacagactgtctcttgtgtccttctaagctgggca

SEQ ID NO: 276932 - DNA, 939 bp, Homo sapiens
gaagagactgactagtcctcccaaagtacttgtgtccgggtggtggactggattcgctgcggagccctggaagctgcctttccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaacgtggcctcgttgacctcagcggtgagcgtctcgcaaagc

SEQ ID NO: 276933 - DNA, 778 bp, Homo sapiens
caccttaacacagagctgtttgtgaccaccatcatgagacccagtaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaaatcatccaggaaaaaaaa

SEQ ID NO: 276934 - DNA, 855 bp, Homo sapiens
gggatccagccgctctaaagttctttctgttccaggtggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaaatcatccaggaaaaaaaa

SEQ ID NO: 276935 - DNA, 922 bp, Homo sapiens
gaagagactgactagtcctcccaaagtacttgtgtccgggtggtggactggattcgctgcggagccctggaagctgcctttccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaaatcatccaggaaaaaaaa

SEQ ID NO: 276936 - DNA, 846 bp, Homo sapiens
tagtcgtaccgggttatcgatgccaccatgtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaaatcatccaggaaaaaaaa

SEQ ID NO: 276937 - DNA, 1143 bp, Homo sapiens
agttgggacgacgccggcgccgccgcgctgctgctgggctccagcctcccggccagctcgcggccactcagaaactccggcagggcagcccaggccggacgtgggcccaggagcggacgcgcgcgctgcactgcagccgctgccccttccggatcagcatcgccccgcgcgccaggcgcccaatgtcacggcggcgcgcggagccgggctgcggaggcagcgggcggcgcgcaggggcgccgggagaggggcgaggccgccgccgctacgcgcccgggcccgcggcgaaggcgctgccgcgaagacgcctggcgctgcagtcccaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggatacagaaccccttcttttccaaataaaaaaaaaaatcatccaggaaaaaaaa

SEQ ID NO: 276938 - DNA, 893 bp, Homo sapiens
gaagagactgactagtcctcccaaagtacttgtgtccgggtggtggactggattcgctgcggagccctggaagctgcctttccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtaacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgccgacctgaagaaagggaagattcagggccaggagttatcagcctaccaggctccctccccaccggcacacagtggcttccatcgctaccagttctttgtctatcttcaggaaggaaaagtcatctctctccttcccaaggaaaacaaaactcgaggctcttggaaaatggacagatttctgaaccgtttccacctgggcgaacctgaagcaagcacccagttcatgacccagaactaccaggactcaccaaccctccaggctcccagagaaagggccagcgagcccaagcacaaaaaccaggcggagatagctgcctgctagatagccggctttgccatccgggcatgtggccacactgcccaccaccgacgatgtgggtatggaaccccctctggataacacgttcgcgagggggatct

SEQ ID NO: 276939 - DNA, 590 bp, Homo sapiens
tgcgggcccttgcgggggctggttccagcagcaaccgccgggcagggcccctcccgaccgcgacctcctgtccgcaccgtagggcagccggccgggccagcctccctcacaggactaccgaggaagaggtaggatttcactctgtcacccaggcgggagtgcagtggtgcgatcatagcggggactacaagtgtgcaccacatgcttgtctacgaacctgaagtattctgatgcagtggagagagtgtagaactctggagtgaagagatctgcctggaaccctgactctatcactaggagattccttggaatgaaaccaatgggagtccagggtttgggagagtctcatcagagcagatgggcgagcagcagccagaacgcttgttgcctttggctgagaacactatcctggatctgaatgtcttatcaggacctgaagtaggtggctgcccatccaggtattctacaggcacttgcccgtgaaaccttcaccactccttgaatctggttctgcaaagtgggacagctgagacttaggctaagtgacttactgaggcagcagtcagcaccgtgtgggaccagcccccatg

SEQ ID NO: 276940 - DNA, 589 bp, Homo sapiens
tgcgggcccttgcgggggctggttccagcagcaaccgccgggcagggcccctcccgaccgcgacctcctgtccgcaccgtagggcagccggccgggccagcctccctcacaggactaccgaggaagaggtaggatttcactctgtcacccaggcgggagtgcagtggtgcgatcatagcggggactacaagtgtgcaccacatgcttgtctacgaacctgaagtattctgatgcagtggagagagtgtagaactctggagtgaagagatctgcctggaaccctgactctatcactaggtaattcctataatctccctaggcctgttttctcagctggaaaattgattgatttgtggtatttgaagtgcctttgagcttgggatatccatgctggtgtttggctacagtatagcatagtggctagagcacaaactctggagttagaatgtttaggttaaacctcagcaactcacaccaaaggtatgtgactgtgggcaagttattagcctctctgagcctcagtttcttcatctgtagactggggataataatagtaaatatactgctgaacagttttaaagattcaatg

SEQ ID NO: 276941 - DNA, 775 bp, Homo sapiens
atggagatggctaacagctagagcaggctgtcctcggagggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgcctcgcacctgtactcctcgaccactgtgctcaagtaccagaaggggaactgctttgacttcagtacgctgctctgctccatgcttatcggctctggctatgatgcttactgcgtcaacggctacggctcgctggacctgtgccacatggacctgacgcgggaggtgtgcccactcactgtgaagcccaaggag

SEQ ID NO: 276942 - DNA, 1220 bp, Homo sapiens
ggaaaacagatgttcgaggacagaaatggaaagaccccagctgggaggctgcagatagtgcatcagctgggatggcgttgggtggtgtggaacagggacccccatagaagctgaggtttcttatataaggaaaggctagaggtggcactccaggcctctgtggcactgctggggaccccagctcccccatctctcggccctgccgtccatagcaggcagctttagccctcatgtgtggccacctcatggtctcgccttggctgccccacctcccactttatctccacattccaggtgggaggaggagaagggcagagggctccccaatcacttctgcccacatctcattggccagaaccgggtcacatcgcagggccacctctagctgcaagagaatctgggaagctgagcaattcaaaccaggcacactgctgccccccacacaactggggttctgccgtatagaagaggagactggatctttggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgcctcgcacctgtactcctcgaccactgtgctcaagtaccagaaggggaactgctttgacttcagtacgctgctctgctccatgcttatcggctctggctatgatgcttactgcgtcaacggctacggctcgctggacctgtgccacatggacctgacgcgggaggtgtgcccactcactgtgaagcccaaggag

SEQ ID NO: 276943 - DNA, 944 bp, Homo sapiens
taacgacgagaggacagccaacggcgagccgatcgcgagagcggaggagaggcaacagcagagcaggcgtcccggagggaaccgggtcacatcgcagggccacctctagctgcaagagaatctgggaagctgagcaattcaaaccaggcacactgctgccccccacacaactggggttctgccgtatagaagaggagactggatctttggagacattccatctccagacacccagagacgctccagaatggaggtcctgagggagaaggtggaggaggaggaggaggccgagcgggaggaggcggccgagtgggctgaatgggcgaggatggagaaaatgatgaggccagttgaggtgcggaaggaggaaatcaccttaaagcaggagacgctcagagacctggagaagaagctgtcagagatccagatcactgtctcagcggagctcccggcctttaccaaggacactattgacatctccaagctgcccatttcctacaaaaccaacacacccaaggaggaacacctgctgcaggtggcagacaacttctcccgccagtacagccatctgtgcccggaccgcgtgccctcttcctgcaccccctgaacgagtgtgaagtgcccaagttcgtgagcacaaccctccggcccacactgatgccctaccccgagctctacaactgggacagctgtgcccagtttgtctccgacttcctcaccatggtgcccctgcctgaccctctcaagccgcctcgcacctgtactcctcgaccactgtgctcaagtaccagaaggggaactgctttgacttcagtacgctgctctgctccatgcttatcggctctggctatgatgcttactgcgtcaacggctacggctcgctggacctgtgccacatggacctgacgcgggaggtgtgcccactcactgtgaagcccaaggag

SEQ ID NO: 276944 - DNA, 249 bp, Homo sapiens
ctatttagagaaagggtgattatccccactgtttctccatttaacagcccaatttggtctgttcttaggcttggaaagaatgaatggtgcctctcggtgaattactacaacctgaatcctgtgaccccacctgtgatggcccaatgttattgaaattactgactccatccacttagcaagtggtaaatactctgcaggcatagatttgactaatgtgttctgttcagcgcctatttcaacagatctcag

SEQ ID NO: 276945 - DNA, 937 bp, Homo sapiens
agtgtagatatagacttttaaaggtaaaaagaaagaataaagatggagggtgtgataatcctatgaagtgtctgggtttgggtcctgagggcagccaattacatcccagactcactggcaatcaacagtccaagccagggtcccatcagctgaatcctgaggtggggatgcttcagtctttacagaacagggtcaaggaagagtccagaaaccgccgtcattggcttcatgaaaaccgagcacgtctttgagatctttttcaaattctgcctctaagtcaagtcctacctggccaaagtcagaagccagctggtcctgaggctgcatctgcctctccagggtcttagatacatgatggcactgttggcttcctgaagacctcttcatcctgcagaaggtgcaactccacagcatcctgagaggttggacacaaggtgagcagagggcaaagcccctggaaatggccaccattcctgtggctgccactgtcttccctcaggaaggatgggctcagccatgagggtgggacacctcccagagtgtccaagatccccacatggggtctccagcattggcccttccctcgcatcagtggtagcggcaggcgggcagcctgaggaaggtggtgtcactgttaagtgtgggctctcttttccctgtctgagctgctgggagcacaaaggaaccctgcctgccaggcttgagtgtcagaatctgggctttcacctgcagggacctcaggcctccatcagccaggcttggaaagaatgaatggtgcctctcggtgaattactacaacctgaatcctgtgaccccacctgtgatggcccaatgttattgaaattactgactccatccacttagcaagtggtaaatactctgcaggcatagatttgactaatgtgttctgttcagcgcctatttcaacagatctcag

SEQ ID NO: 276946 - DNA, 951 bp, Homo sapiens
accttcctcacccccgccatttccaggactcacatccaaaggcgacagcaccaggatttgctcccgcctttggcacagaggaggacgggtccctctctcagcctggccagtctttcccagggcttgatgggaaaaaggacttccctagaaggcgggcaggtccggacgcgctgggccctggtcccttcggccgcaaacggcgcaagtcacgcactgcgttcaccgcgcaacaggtgctggagctggagcggcgcttcgtcttccagaagtacctggcgccgtccgagcgagacgggctagctacgcgactcggcctggccaacgcgcaggtggtcacttggttccagaaccggcgagccaagctcaagcgcgatgtggaggagatgcgcgccgacgtcgcctcgctacgcgcgttgtccccggaagtcctgtgcagcttagcactgcccgaaggcgctccagatcccggcctctgcctcggccctgccggccctgactcccggccccacctgtcagacgaggagatacaggtggacgattgaagacaaagccgccgccaatcctgggctctggggccctggactcctcacctcgcgctctgcctctggccagagttccagggtggaggaaggaggtccacttgggcctcttccggcccacagtccagacgctcacctttcccggtttttttgtaagtttgttttgttgtctgagacagggcctcgctctgtcgcccaggctggagtgccgtggagcgatcaccgctcactgcagtcgcgacctcctgggctcaagcgatcctcctgcctcaacctcccgactagctggcattacaggcgtgcagcaccaccccaggctaatttaaaaaacttttttttttagagaggaggtcccgctatgttgtccaggctactttcccaatatttgagaataaagtcgagactctgccgc

SEQ ID NO: 276947 - DNA, 873 bp, Homo sapiens
ttctgatgacataaattccttggtataatagagttataaaaaaggaatataccaccattctgcctgaattttgtggtacatttcagttacttatatcaattgaaattactgaatattttgccatgaccatttagaaaaaaagtgtaatgctattgatttaattcaagtacatttaaattttccatgaggagtgttccttttcccaccaaattgcataaagcataacagtatagatccctttttcaagaatttttaaataaaatgtaacttttatcaatttgtttagattgtttaaaaggatactttgaaaaaaatcattatttcttgctttagtaactggaggacatctctttatctatatagaatccatgcccaaacttaatattcctctattttcttgattttagaggtgaaaagccaggcatccttcaagctagtggatctttgacaaagatgcattgcaaaacaatcaacaaacaatcagaaaggcatgctatgtgtgagtgatgatccctgcagcatatgccataggcttgttgtagaggagctgctcagtaaatggtggattcaattgaaacaagtcttttttggatgcttaatgggaagttgtagggtgggtatgatggactaaaaattatttctaaagaaggttatatattgtatatattccagaatcttccgtttttatcgtttcttaaattaaaaaataaaaatttaactctgtcccaggttaactcagatgttaacacttatatagaaatttttttcctctttccccgttaggcatctcacagtattttctgcttgtctgtttaggatgttaggtagaggaaaagagagtgatagaagattttttttcttaaaaaaaaaaaa

SEQ ID NO: 276948 - DNA, 3358 bp, Homo sapiens
ggagcggggcgggcggctgggcggcgggcggcgggcggcgcgggagggcgggcggagggaaccaggccggccggagcgtgtgcgccgcccgcggtccggtcacgtccccgcgtgggcgccgctgcccgcgtcgtacggaacgagggcgccgcggccccgtgctcgccgccccgccccgccccgccctgcccggagcagctcggcagatgctctgtgctgcggcccggaggtgaagggctggatgcacagtgggagccggaggcggggggctgcagggagcacaccagcgaccggccctccaaccctccagccactcagcaacatcgccacagcaaccagcaaccagacggcagcagccgaggcaaacacaagcggacggcttcccaccgtcgccgaggacagggaatgactacggcaaatcaggccactttgccaactagggaggtggagtgtcactagtggggaggggcggccaccgcccgctgcacagagcgccatgccggctggagaagaggcgctggggcaggggctgcagtgtggctcggcctcacccccctgctggcactgagtgcctccagggcagctgggctcttgtctgcctggtctcagtgtcccctgtggcaagagggagaggtgccccatcccgtgctccttgtctgggcccgctgctgccagaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacaagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcgcctggaggagggccagctcgctgcccgagctctggcctagggaccttgccgctgaccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacatttttttttgttttttgttttttggttttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctccgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatggagcccagcat

SEQ ID NO: 276949 - DNA, 3171 bp, Homo sapiens
ggagcggggcgggcggctgggcggcgggcggcgggcggcgcgggagggcgggcggagggaaccaggccggccggagcgtgtgcgccgcccgcggtccggtcacgtccccgcgtgggcgccgctgcccgcgtcgtacggaacgagggcgccgcggccccgtgctcgccgccccgccccgccccgccctgcccggagcagctcggcagatgctctgtgctgcggcccggaggtgaagggctggatgcacagtgggagccggaggcggggggctgcagggagcacaccagcgaccggccctccaaccctccagccactcagcaacatcgccacagcaaccagcaaccagacggcagcagccgaggcaaacacaagcggacggcttcccaccgtcgccgaggacagggaatgactacggcaaatcaggccactttgccaactagggagaggtgccccatcccgtgctccttgtctgggcccgctgctgccagaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacaagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcgcctggaggagggccagctcgctgcccgagctctggcctagggaccttgccgctgaccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacatttttttttgttttttgttttttggttttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctccgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatggagcccagcat

SEQ ID NO: 276950 - DNA, 1362 bp, Homo sapiens
gcggccgcgtctccttccgccgcccggaaatcagggcccctccccctccctgctgtgctcacgtgatcgcagcccgcagccgcgcgcaaccggggaggcgggagcgggagcggtaggccccgcccacagaggagggtaccccgccggaagccccctgctctgtgggaaccggagggaggacagcgcgaggtccccggacaaagcgtggcgcataagtccggcccgtaacttggtgggcaggcaacttaggggatgtgggcctggttatagctgagcatgcttttctattcctcccagaccacagttcttcagacctggagccactttcagagaagagtataagttgcactgaattgaaaaagggaaaagtttaggactgcagaagatggaattcctggggacgttaaactgggctaagatggagcagataagatttccttaattagagcaagacacacctagtatctagagcctggaagtcttggtcaaggattctccctaacatctcagtttctcagcactaacattcctgctactaaaatgaagtgagaaattaatttctgaagttaagtaaagaaataaactaaaattcctagaaaagaggtaagaagaatgagcctttgaaaaatgtcttcacaaagactggcatgatggcatggaagaaagagccccagatatccagtatacatctcaaggtcaacttgtccaaaacagagctactgatgattttccccttgaaatctactcttcctacagcttattcatctcaaatagctggagtacagtggcatgatcatatctcactgcaacttctacctcctgggctcaagcaatcctcttacctcagcctcctgagtagctgggactatagtctccctctcttgccaagcctggactgtactgccatgatctcagctcgctgcaacctccctgcctcgagttctggtgattctcctgcctcggcctgacattccaggcaggcgccgccactcctgactggtttttgtatttttggtggagacggggtttcaccgtgttgaccgggctggtctccagctcctggcctcgggtgatctgcccacctcggcctcccgaggtgctgggattgcagacggagtctcgctcactcaatgctcaatgttgcccaggctggagtgcagtggcgtgatctcagcttgctacaacctccacctcccagccgcctgccttggcctcccaaagtgctaagattacagcctctgcccacccgccaccccgtctaggaagtgagcagcgtctctgcctggccgcccatcgtctgggatgtgaggagcacctttgcccggccgccccgtctgggaagtgaggagcgcctctgcccgg

SEQ ID NO: 276951 - DNA, 1026 bp, Homo sapiens
gcggccgcgtctccttccgccgcccggaaatcagggcccctccccctccctgctgtgctcacgtgatcgcagcccgcagccgcgcgcaaccggggaggcgggagcgggagcggtaggccccgcccacagaggagggtaccccgccggaagccccctgctctgtgggaaccggagggaggacagcgcgaggtccccggacaaagcgtggcgcataagtccggcccgtaacttggtgggcaggcaacttaggggatgtgggcctggttatagctgagcatgcttttctattcctcccagaccacagttcttcagacctggagccactttcagagaagagtatatccagtatacatctcaaggtcaacttgtccaaaacagagctactgatgattttccccttgaaatctactcttcctacagcttattcatctcaaatagctggagtacagtggcatgatcatatctcactgcaacttctacctcctgggctcaagcaatcctcttacctcagcctcctgagtagctgggactatagtctccctctcttgccaagcctggactgtactgccatgatctcagctcgctgcaacctccctgcctcgagttctggtgattctcctgcctcggcctgacattccaggcaggcgccgccactcctgactggtttttgtatttttggtggagacggggtttcaccgtgttgaccgggctggtctccagctcctggcctcgggtgatctgcccacctcggcctcccgaggtgctgggattgcagacggagtctcgctcactcaatgctcaatgttgcccaggctggagtgcagtggcgtgatctcagcttgctacaacctccacctcccagccgcctgccttggcctcccaaagtgctaagattacagcctctgcccacccgccaccccgtctaggaagtgagcagcgtctctgcctggccgcccatcgtctgggatgtgaggagcacctttgcccggccgccccgtctgggaagtgaggagcgcctctgcccgg

SEQ ID NO: 276952 - DNA, 1354 bp, Homo sapiens
  misc_feature (52)..(52): n is a, c, g, or t
  misc_feature (1175)..(1175): n is a, c, g, or t
tgcctacccacgtgggggaatttctctgtcaagtttctgctgctttgcagcnatttaaaatgggtcctgaaatatctgcagtgcagaacatctgagaagagcttttcatttgctagaatgttgcagcaagcaggctaagcgatgttagcaggcaactttgtgatagatttagaaagccccgaagaaatgggtggtggtgatacagagagattttttctttcctttttttccttttttggcttgtctgcagaatagatgaaaagagaaaatatacccagatactttgctcactctcccaagtgcacactaggcaatgtaagctccagaggcagcgcttacaggaggggaagggacgctgaggccaagagtgctggctcactggggtggaagggacttcagagggcgttcctcactcctcttattgcaggtgaagaaacagaggcagtggtcctttgccccaggccattcagctggccagtagcggagcccagggctacccagatcctccaatgcccaggctggtcctctttcctttctgaccccaacacatgaagagtccatctggaaatgttggctcccacacttcaaaacattaaactccttgttctctttctccaaatgattaatttgttttcagtgtttacattagctggaagccaagttgggaacactcctaactcgtttctcaaacaagatgtttttaaaatgaagtttcccagcatggaatgctttgctactttgtaagggcttcagttgctaagaacttactgcacctgtgtcaaaactgtgctctcagggcccctggtggagtccagaagaagagttccacgcagtccctgtttttcttttttttccaggaactcctggaaactgaatcacagatcagatcatgttgttccacaagaacgatgtgtcactgtgaggctgcattcctgaccacgaactgagcaccaaataagtcatggacatgcaccaaaaggtgtgacccaagggaggcagggtgagccccatgtctcagaacatcctcgcggacagcaaagcccttgatgtggtggagtaggggcctgtggcaacccctcacacatggcaggtcctttgcaaccccaagtgcttcagatgctaccagccctccttgggcaggtctgagatgtgacagagaagaagatgagaatggnaaaagagaaagaagagcggaaaactaaaagagggaagggcagaggaaagagcagaaatgcagtctagctggagggcaggctgctggctccagccactgcctcagatccccccgacctggggtactcaggagtctgagtgggtacagggctatagcctcaatttccccatctgatgtggg

SEQ ID NO: 276953 - DNA, 805 bp, Homo sapiens
agctaccaggcggcaagagcagtgaagcacccgtcgtcacgctggttccctagtgcagacttggaatatgctggagaatattcagaggagcatgggtgcttgctctgacatgagtctcagaggtgcagacacgcacctgcaacgtcctaactttccttagaagcaatttggaactatcaaccacaatatatttatccaaagtccctataaactaagactttctggcatcctttatcttgaagttgaaccaactgaaaacaccctttgactcctcttctgcctgtcctactgatgtctatcaccttctcctgcctgatcccagccccaccagaaggtcataagcgaagtggccttctcagaatgcagctgctgaaggttcagccacacagaatccatccaggagcctcaagcagccagacctcaagcctcttgggaaaaacatctctttcaaaataaaggcacgagaatcacgttctgtcagcgcagtcgccactgtctggaccgctgcacaaaagcagacacgagtggagtgaggcccgcggcggagccctccctgcctcctggcggcgtgggctcaggccagggccagggcgcaccaggaatccggtcgcacggaggacgtgacttcggccggcgaggcgagactgacgcctatgtagagcccatcttgacccgaatacttgagctcgctgttctcgggattggtgctctctcccgcaccagtcatcaccggggcacccgcctggcagaagagggggacacagaggagagacgagaaggtgagaagcggttacaatcctggtag

SEQ ID NO: 276954 - DNA, 2647 bp, Homo sapiens
agtcgctgcagtcgtccgcgggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgaatatcttaaacatctccaatggcaactactaccccattatggtgacacagctgaccctcgaggttctgcacctgtccctcgtggtggggcaggtttccaacaaccttctcctacacattggccctttggccagtgaacagatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacctggcctttctgtactgagcacctggtcagtctgaagggggcatttcaccccagctccatcagggctggctgtcccgtctgaatgtggagagagctgtagttttatctggcttttaaaacatggacctgccggctgggcgcagtggcttacacctgtaatcccagtactttgggaggccgaagtgggtggatcacttgagggcaggagttcgtgaccagcctggtcaacatggtgaaaccttgtctctactaaaaatacaaaaattagctgggtgtggtggcatgcgcctgtaatcccagctactcgggaggctgaggcagcagaatcacttgaaaccggaaggcagaggttgcagtgagccaagatcgtgcaactgcactccagcctgggcaaaagagcaaaactttgtctcaaaaaaagactcttttcaagttttctaccctctgataagaaaatttggggatatccagtgccatctccaaggactttcaggggatcatagatgcttttctgtgcctatctgctttgaccatgtgaaaaagtgatagtctgcttctctctggtaacttgtctgccacccatctgatagtaagattagccaaggccctttagccctctgtcctttctggttattgactgtccctggttcctaggaagacagagttgttctccagctaaagcgtctcctctctataaagtagttttactattcttttcatagcaggagccaaaatagtagaggaggggagagaggcacctggcactctgcgggcctgcacaggaaaaacagagccaaagacagaatcattgtataagatatttattaaaggagagcctctaagtccacatcctgagcccatgtgagtggacacaggtaggtaaaacggtgggtccagctgctgtcatctgaaagccttcaggagatgaagctatcagtatccagctgaaggctgctgggttctgttccaccaccaccttagcaccagggccctctctggtcccagaggcctcatctctccttgggctttgacaatgtggagcagcacatcagcagggactggtctagaccctccctttcctgtcacttagctggagctaagctccagataacccctaggttcccactggctcctagtagaaatagtttctgtactttagcagaacaggaaggatatttgttcattaaaggtggcttggtctt

SEQ ID NO: 276955 - DNA, 367 bp, Homo sapiens
ggaaagtgggcccgtaaatatttaaccccccaaccccgtttttttataaaaaaccccaaaaaaaaaaaaaaaaaaaaaaaaaaagatggctgtctctttatcattcagacagaacgatgaacacaggtgagcagggaaagctaattttgaagtagggtgcatggagagggagaagtggtgacagaacttggtaactagctggctgggggaacgaggggaaggaaggagactgctgtctccaagctgaggtcagggtggtgttggcaagagcgcaaaagtccagggaagccaggctggagctgctgtgtatagactgccaaatgtgaagtatttatattgtattcaataaactatacttaagagtgtt

SEQ ID NO: 276956 - DNA, 3599 bp, Homo sapiens
agtcgctgcagtcgtccgcgggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgaatatcttaaacatctccaatggcaactactaccccattatggtgacacagctgaccctcgaggttctgcacctgtccctcgtggtggggcaggtttccaacaaccttctcctacacattggccctttggccagtgaacagatgttttacgcagtagctaccaagatacgggatgaaaacacatacaaaatctgtacctggctggaaatcaaagtccaccatgtgcttttgcacatccagtaagtagagcttggagctctggtatccctgctctcacttctgacttcattctcactcagctacacctcatgggcagagagtcttccaagctgaccccatgaatctttgttggctcttgggaatagcaagtctagccccttttctgagtctcaccttgcctataagttattaggggcaacaggcatagggctgtctggaagctgctggaaaacaggtggggcagctgtcccaggtaccttggcagagtggggagccagagggaagggcaaatgagggagctccccgctccccacccccagacagtataatggggccagagctttccttttcctcccagccatggcaacaaggcctgcttcctctccaggggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacctggcctttctgtactgagcacctggtcagtctgaagggggcatttcaccccagctccatcagggctggctgtcccgtctgaatgtggagagagctgtagttttatctggcttttaaaacatggacctgccggctgggcgcagtggcttacacctgtaatcccagtactttgggaggccgaagtgggtggatcacttgagggcaggagttcgtgaccagcctggtcaacatggtgaaaccttgtctctactaaaaatacaaaaattagctgggtgtggtggcatgcgcctgtaatcccagctactcgggaggctgaggcagcagaatcacttgaaaccggaaggcagaggttgcagtgagccaagatcgtgcaactgcactccagcctgggcaaaagagcaaaactttgtctcaaaaaaagactcttttcaagttttctaccctctgataagaaaatttggggatatccagtgccatctccaaggactttcaggggatcatagatgcttttctgtgcctatctgctttgaccatgtgaaaaagtgatagtctgcttctctctggtaacttgtctgccacccatctgatagtaagattagccaaggccctttagccctctgtcctttctggttattgactgtccctggttcctaggaagacagagttgttctccagctaaagcgtctcctctctataaagtagttttactattcttttcatagcaggagccaaaatagtagaggaggggagagaggcacctggcactctgcgggcctgcacaggaaaaacagagccaaagacagaatcattgtataagatatttattaaaggagagcctctaagtccacatcctgagcccatgtgagtggacacaggtaggtaaaacggtgggtccagctgctgtcatctgaaagccttcaggagatgaagctatcagtatccagctgaaggctgctgggttctgttccaccaccaccttagcaccagggccctctctggtcccagaggcctcatctctccttgggctttgacaatgtggagcagcacatcagcagggactggtctagaccctccctttcctgtcacttagctggagctaagctccagataacccctaggttcccactggctcctagtagaaatagtttctgtactttagcagaacaggaaggatatttgttcattaaaggtggcttggtcttacagctgggtgcagtggtatatacctgtagtcccagctactcaggaagctgaggtgagaggatctctagagcccaggaattcaagtttaacatgagcagcaacattagcaagaccccgtttaaaaaaaaaaaaagagctgggcgtaatggcgcacacctgtaatcccacctactcaggaggctgaggcaggagaatcacttgaacccgggaggcagaggttgcagtgagccaagatcgcaccactgcactccagcctgggcaacaagggcgagactctgtctcaaaaaaaaaaaaaaaaaagatggctgtctctttatcattcagacagaacgatgaacacaggtgagcagggaaagctaattttgaagtagggtgcatggagagggagaagtggtgacagaacttggtaactagctggctgggggaacgaggggaaggaaggagactgctgtctccaagctgaggtcagggtggtgttggcaagagcgcaaaagtccagggaagccaggctggagctgctgtgtatagactgccaaatgtgaagtatttatattgtattcaataaactatacttaagagtgtt

SEQ ID NO: 276957 - DNA, 414 bp, Homo sapiens
aaatatttgtcacagttgcatcttggccctccctctcaccttctctctctctagagctggagaagcagttggtggctctcattccctatggggaccagaggctgaagcccaagcacacgtaagccccccttcctcccctagcttcacaagccattgcccctgggggctgctccctttgtctcccctgttttgatctcccttaatttcttcctattagttcttccatagaaagcctgagcctcagaggtaccagctccttacgtccaaggattttttcctgatttagaagctcctggaccgggtgtggtggctcatgcctgtaatcccagcactttgggaggccaaggcaggcagattacttgagctcaggagttcaagaccagcctgggcaacatggtgaaaccccatctctat

SEQ ID NO: 276958 - DNA, 809 bp, Homo sapiens
gcacgtccagaatgaaccggatccggtcgccgttggtgcgctggagcaccttggcccccacctcctggtagacgccctgcaggtacttcaccaccaggtccagctgcccctcatcctccagaggagtaaaaataactgcactgagttgacgtgttggtgctggaagtcgccacaacaaaatgagtatttccagaggggaaatagacatttctgagttagacaaatcccttgcagttcatcgacagcacatgatgaaagctggctgcagatccagggagcaggaagccactctgcagcaagacgtctgccacgtggtatcggccaggctcactgcagcacttgagcgcccacagggctcccgacgctgagctagggacgcccccggccgcaaggggctggctaccgaggccaccgtgacatggggtggactgagacagtcggccagggaaggcggtggccttgcgcagaggctctctgctgtagccttgcctggtggccctgggtaaactgtcctcgccggagccccagcttccttacccgtaaagcggggaaatggggccgcaacttcccaggacagttgtgagaattcagcgcagtgactgagcccacgatctaactctaacggccagagcgcagcctggctctgctacttcccacaatcattcacacgcgtacaccgcagccatggatttcaagagctacacacagaggacatatttactaatcacaaagtaaaccatttaaagcaagcacaaaacatcatccacctaccagaagcgtctgtttctctttacaatcaaagtgcttta

SEQ ID NO: 276959 - DNA, 498 bp, Homo sapiens
tcaattggaagaaaaaatttcaaaagggtgtccacagaggcgaaaaaagcccaggctctaccgaccttcaaactacaacagagctttcaggagaatgcggagagacggcttcccacccggacctcaccagaaacccgcacaccccagccacattgctcctcattcagccagaaaggactccaactccaccaccaggaggccccccttcctggtgctggccagttgcagaggctgttcatggcatcccacaggtggcgactgccccccaccctcctcctagcactttagagggtccctctgtggcagacaccatggctaggtttctctttccaactcctgttggtctggcaagtgacagatcatcttcactacattaatcagtagtcacccgaacattcctatactgtcccccaattcctttcagcaccagctgcctcccccactggaattattcaatatggaactagattaaattgaagacttgccctttagttttta

SEQ ID NO: 276960 - DNA, 727 bp, Homo sapiens
tttttttttttggggcatgagtttatacaacatgctacactacgcacttggtagcagtattcaaataaaaatatgattgctgcctcaggtcattccaaaagtatagtcatccaaaagtatttaaggcctatgctgaggactgaagcacaagtgttaagactgctattccttactctgacctaatagctttcccccattcattctcatcaaatattgatttaacaatggaaagtggcaggaagcttgtgttcccattaaacacaacacttcccctcctccccagaaaacagaaaaaaaaaaagtcaggaacagggaagaaaagtaatcacatttaaatggtgatagaaaaatttaagtcttctatgctttaagcatttaattgcaatgtgtaggtaactcattcatttatttaacaaatattcaggagtaccaggtactgtgccccaggaaattccaacagagtgacatgtgctaaacaggggcaaacaaaatttaagagcacacaggaggagcctaatccagtcactggaggtaaggaaatgttcctggtagaatggtatctaggctaaagagaagagccagaggaaggtgtggtggacaggagcaagtgatttgccaggcagccagctaatacaaaatcgggaggcactaaacatcaccatgagggatagaacatgcactgctggaagcagtgcaaacacatttttctgtgaatcatatcctttgt

SEQ ID NO: 276961 - DNA, 1399 bp, Homo sapiens
tttttttttttggggcatgagtttatacaacatgctacactacgcacttggtagcagtattcaaataaaaatatgattgctgcctcaggtcattccaaaagtatagtcatccaaaagtatttaaggcctatgctgaggactgaagcacaagtgttaagactgctattccttactctgacctaatagctttcccccattcattctcatcaaatattgatttaacaatggaaagtggcaggaagcttgtgttcccattaaacacaacacttcccctcctccccagaaaacagaaaaaaaaaaagtcaggaacagggaagaaaagtaatcacatttaaatggtgatagaaaaatttaagtcttctatgctttaagcatttaattgcaatgtgtaggtaactcattcatttatttaacaaatattcaggagtaccaggtactgtgctaggggctgggagtaaacaagacatagtccttacccataggaagttatattttgtatctccccaggaaattccaacagagtgacatgtgctaaacaggggcaaacaaaatttaagagcacacaggaggagcctaatccagtcactggagtttcagcacatgagaacaaaagtacgccctttgaaaaagtagcagtagatcaaaagcacagagatgctgctgcatttacttttacttcaggttttctgtagtgcttccacagcaagatggacgctgtttaaagtattgccaatggaagctacactctgaatggaaacatataggaaggtgtaaaaaagctttaagagacaactgacatgcaataaactgtacatattcaaaaatgtataatttgaatgttttgacacataaacaattgtgaaaccagtactacaatcaagataataaacactcatcacctctgaaaaaaaaaaagtaaatataatacaattaatcttcatttttattatttatgatatactacgtccaatatacaacttaactccgtctcctccccgtatttttcccagcaatacttgagtggttgatcagccaagtcctgtcccgtcttcatttttctcatgttgctacctacaccccccccaatcagctgcgacggtcgcacatacaagattggatgatgtatttatcagaagcatgctgtttatcataagctgaggagatgagctccgtgcacgatgatttgtcaatcatataatattatccttcctccccctatttacttattcatttacgctaatttatcttgattcgcccttgaatgtcttgactcgtttgtcggaagtcttatctgttacagtagtgcgagctggtcctagttgcacaatcaaatgtatctacactgactgtatgtattcgcgttttcctatctattatgcaatatgactgctacatattg

SEQ ID NO: 276962 - DNA, 990 bp, Homo sapiens
ttagttgcagagccagttctcaaatctacatctgccttgcatcaaagttactggtatgaaagttattgatcatcagttgcttggcatcaaagccccaggaaattccaacagagtgacatgtgctaaacaggggcaaacaaaatttaagagcacacaggaggagcctaatccagtcactggagtttcagcacatgagaacaaaagtacgccctttgaaaaagtagcagtagatcaaaagcacagagatgctgctgcatttacttttacttcaggttttctgtagtgcttccacagcaagatggacgctgtttaaagtattgccaatggaagctacactctgaatggaaacatataggaaggtgtaaaaaagctttaagagacaactgacatgcaataaactgtacatattcaaaaatgtataatttgaatgttttgacacataaacaattgtgaaaccagtactacaatcaagataataaacactcatcacctctgaaaaaaaaaaagtaaatataatacaattaatcttcatttttattatttatgatatactacgtccaatatacaacttaactccgtctcctccccgtatttttcccagcaatacttgagtggttgatcagccaagtcctgtcccgtcttcatttttctcatgttgctacctacaccccccccaatcagctgcgacggtcgcacatacaagattggatgatgtatttatcagaagcatgctgtttatcataagctgaggagatgagctccgtgcacgatgatttgtcaatcatataatattatccttcctccccctatttacttattcatttacgctaatttatcttgattcgcccttgaatgtcttgactcgtttgtcggaagtcttatctgttacagtagtgcgagctggtcctagttgcacaatcaaatgtatctacactgactgtatgtattcgcgttttcctatctattatgcaatatgactgctacatattg

SEQ ID NO: 276963 - DNA, 833 bp, Homo sapiens
gaccccaggagcaggggtcgcgccgaagagcagagtccgcggctggaaaccaggcaggggagccacggagtagtcacacaggttttctgccgcctttcaactggtcttattttgctttcatttttcaccagcccatgtggggtgtttaatgttgcacgcgaacgcagtttcttccgggcccggaaggcccacgcacgcaacaatgttgtgcaagtgactggaaaccacctgagtgtccctccatgggggtgggttgcccagcatggacctctactcctgtcacaatgaagtcgactgtttcgtcgagggaagtggccaccgttgataaaatgaaaagacgccatgcagaatactgtgcacaggaggaaaggtctgcgtgccctaagagagagctgctggcgtgcagagagaagcagagatgccgacgacggggaggaaacacactggcggtggtgaggctccttccagcagccacagccctggttcctctcagtctgtgaccctcccacatccttcccatctatgagagcctgtaaactccttttgcttaaccttgttttagttaaggttttaaacaattgccaccagtgtgccctaaaccaccccagtggcttgagtgtttctccgcttcttttgcctaggatgctgcggagatggacaggacaggagactaaggaggtgagaaccctggcccacaccatcactaagggcccttcctgaggtctgcttcccacatgaagtcctcccagggccctgaatccagccatccacctccttgttggacataggctccattagagagatgcggggctccagccccccttgctctgcct

SEQ ID NO: 276964 - DNA, 635 bp, Homo sapiens
gggggacagagcgagaatccgtttcaaaaaatagagaaaagaaaaagtcttgagtgctggacaagcctgtgactcaggactcggaatgataaacaagagagaaatacactgagtttctatgatagtcactaactcggggctgccggcactcgtgttcccctgcagaggaaaggtctgcgtgccctaagagagagctgctggcgtgcagagagaagcagagatgccgacgacggggaggaaacacactggcggtggtgaggctccttccagcagccacagccctggttcctctcagtctgtgaccctcccacatccttcccatctatgagagcctgtaaactccttttgcttaaccttgttttagttaaggttttaaacaattgccaccagtgtgccctaaaccaccccagtggcttgagtgtttctccgcttcttttgcctaggatgctgcggagatggacaggacaggagactaaggaggtgagaaccctggcccacaccatcactaagggcccttcctgaggtctgcttcccacatgaagtcctcccagggccctgaatccagccatccacctccttgttggacataggctccattagagagatgcggggctccagccccccttgctctgcct

SEQ ID NO: 276965 - DNA, 517 bp, Homo sapiens
gccaggcacaaaaagatcaaatattgtttgattccacagatataagctgtccagaataggcaaatcctaagaaacagaaagtggatgagtgattgccagagcctggcaggggccaaaagaaatggtcaaggcagaaggccagaaaagaacacagataaccagaaccagaagagcacaaaggccattgagaagaaggggctaataaaatattaaattcctcaagtaatgctacccacacaggaatatgatgcttcagatgtgaacgacagaggacctgaaatccttgagccctttaaagagatcactgtgctctgatgcatgtgtgtggaggtctacgaacacctataataggtgatacctgcgaggtcacacaattctgtatcagaagcacttgtcaaagcttcttctaattctggatcaagagacactttttcttctgtaaaagtctgtacaggtttctgtttggggataaatattttccctgtaaaataaagcattttgttaattccattactac

SEQ ID NO: 276966 - DNA, 704 bp, Homo sapiens
ttgccccacttaaatggttaacagtaacagcagcacagacccaaacttgataaaactttggtacttgttatttggactaaaattttgtctcactcgattcagacacgtaaatgggagttttcagtttatcctgcccactgattcataactgggagacagattcatgggaaggcagcattggacacatactccttctcttgctgagaaccaccaatataatctaattctctttttttaggtgagagaagcagaggcccaaaggaatattgcaaatacccaaggtcaccctgtcaggagtggcagaatagggctggaacaaggactcttttctctggacagcttgcacctacaatcctttccatcttgcacctacaatccactcgaacactgcagcatggaggcagactccttgccaacgggtattgtcgagagcttcttcctaccatcatttgaagaaaaaaagcttggagatggggaagaatgattgatcaacatgtttcttccttagtttgttactgctgttgttttaaatcgagaaagcatttttaaacaggatggggggggactgataatatcagtcctccttaatttcattacagccgagtcatcagtattttagtatttcttgcaggttgatgattacaacaatataattttatttattttaattaaactctatttgcttcccacataatttgtgttga

SEQ ID NO: 276967 - DNA, 158 bp, Homo sapiens
acctgatccctacaactcagatttggaaccctgaccagtcttggtgcttctccaatacaaatcctatattttcaaggcatataaatcatattagagatatggaaatccttgcccttgagtcaaaggctaacctttccctagaagattagttgatttgt

SEQ ID NO: 276968 - DNA, 348 bp, Homo sapiens
taaatctccacttccattttcaaacaaaatttcctttgagatttttttccccctctttgggaatagggtctcgccctgttgcccaggctggagtgcagtggcgtgatctcggctcgctgcacctctgcctcctggctttcaagctgaggtgggaggattgcttgagcctaggaggtcgaggctgcagtgggctgtggtctcgccgctgcactccagcctggactacagagtgagaccctgtctcaaaaaaatttatcatggcatgacaaatgctgtgattcggtgtactgattgggtccgaaacatttgctacaaatatagaaaatgtatatactcctaagcataaat

SEQ ID NO: 276969 - DNA, 1216 bp, Homo sapiens
cgggagggctctcctcacacaagcgcttccttgccgagaggctggagctgcggcaccgcaggcctgagccaccccttctctgctgtctccttctcttcctcagggctcccgtgtctgctcgccctccgacgctgctcagaatattaaaggagacaggaagaagtccagatgaagtgactcatggaaccatttgtttatctgaacctgagctaaatcttaggagagaaggactatggaaatgatgttagacaaaaagcaaattcaagtgattttcttattcaagttcaaaatgggtcataaagcagcagagacaactcgcagcatcaacaatgcatttggcccagaaattgctaacaaaggtacagtgcagtggtggttcaagaacttttgcaaaggagacgagagccgtgaagatgaggagtgttgtgcccggccatcaaaagttggcaacgaccaattgagagcaatcatcgaagctgatcctcttacaacactagaagttgccgagaactcaacatcaaccatcctacggtcattcagcatttgaagcaaattagaaggttgtaaaagctcgataagtgggtgcctcatgagctgactgaaaataaaaacaatcgtcattttgaagtgttgtcttctcttactttgtgtaacaacaatgaaccatttcttgatcagattgtgacgtgcgttggtaagtggattttatatgacaaccgctgatgaccagcttggtgggtggactgagaagaagctccagagcacttcccaaagccaaacttctaccaaaatgttaatggtcactgttggatggtctgctgccggtctgatccactacagctttctgagttccagcaaaaccattacatctgagaagtatgctcaacaaatctctgagatgcatggaaagctgcaacgcctgcagccagcattgatcaacataaagggcccagtccttcggcacaacaatgcctgacaatgcgtcgcacaaccaacgcttcaaaagttgaatgaattgggcacaaagttttgcctcatccaccgtattcacctgacttcttgccaactgactaccacttcttcaagcatctcagcaactttttgcagggaagatgtttccacaaccagaatgcagaaaaagctttccaagagtttatcgaatcccagatcacacatttttacactacaggaataaataaacttatttctcattggc

SEQ ID NO: 276970 - DNA, 1126 bp, Homo sapiens
cgggagggctctcctcacacaagcgcttccttgccgagaggctggagctgcggcaccgcaggcctgagccaccccttctctgctgtctccttctcttcctcagggctcccgtgtctgctcgccctccgacgctgctcagactatggaaatgatgttagacaaaaagcaaattcaagtgattttcttattcaagttcaaaatgggtcataaagcagcagagacaactcgcagcatcaacaatgcatttggcccagaaattgctaacaaaggtacagtgcagtggtggttcaagaacttttgcaaaggagacgagagccgtgaagatgaggagtgttgtgcccggccatcaaaagttggcaacgaccaattgagagcaatcatcgaagctgatcctcttacaacactagaagttgccgagaactcaacatcaaccatcctacggtcattcagcatttgaagcaaattagaaggttgtaaaagctcgataagtgggtgcctcatgagctgactgaaaataaaaacaatcgtcattttgaagtgttgtcttctcttactttgtgtaacaacaatgaaccatttcttgatcagattgtgacgtgcgttggtaagtggattttatatgacaaccgctgatgaccagcttggtgggtggactgagaagaagctccagagcacttcccaaagccaaacttctaccaaaatgttaatggtcactgttggatggtctgctgccggtctgatccactacagctttctgagttccagcaaaaccattacatctgagaagtatgctcaacaaatctctgagatgcatggaaagctgcaacgcctgcagccagcattgatcaacataaagggcccagtccttcggcacaacaatgcctgacaatgcgtcgcacaaccaacgcttcaaaagttgaatgaattgggcacaaagttttgcctcatccaccgtattcacctgacttcttgccaactgactaccacttcttcaagcatctcagcaactttttgcagggaagatgtttccacaaccagaatgcagaaaaagctttccaagagtttatcgaatcccagatcacacatttttacactacaggaataaataaacttatttctcattggc

SEQ ID NO: 276971 - DNA, 613 bp, Homo sapiens
gtgttcttgcagctggaatgataaaggaatctcttttctctcttcttagaatattaaaggagacaggaagaagtccagatgaagtgactcatggaaccatttgtttatctgaacctgagctaaatcttaggagagaagggtaaaaataattcattcttattatttttagtccagattaccaggatttttcagatagtgatgtaggtatgggttctggcagtaataaacggcaattttacccagaatggcatctgttaaatatcttcctctggcacttgaagtggtatttggtatctgtttgatagttcaggggttgttctaaaacattgatcctgtgtgcagaaagtaaccattaatctcatgttactactgcttgactcaattttctttatttttattttcttggacttttcttttttaaaaaataagaagagtagcatatttgtaccatctgcaaagcacttttataatggattggaatgtgaaaatctctaatccagaaggaagattcttatatagtctttatagataaatgcaatgtacctttctttaattactgggtgaggtaatatgttgtgaaagaaaatagtgaacttggattcaaaaaaaccta

SEQ ID NO: 276972 - DNA, 291 bp, Homo sapiens
agtaagggtggggattggcacaggggtacccgctgcatctcaggctgcaggacaaacccaagacctcactttgtttccaaattctcacacatggctcctgcctccttcctttccctgaggagaggtttccagatgtccaggacaatgcatgtccccaggaagctctggtaagcccagcctgggcaacataacaagaccccttttttcaaaaagatttttttttttaagatttttgtttttaattagctgggtgtggtggagtgcacctgtaatcccagctacttgggagac

SEQ ID NO: 276973 - DNA, 1319 bp, Homo sapiens
atttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgcgttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagaagctccgcagacgctcagcaggtatcttgatattatcatctgctgagggtggagctgagggtggaaggggagtgagctgacgctcggaaggtgtcttgagatcatccgctgagggtggaaggcaggtgtcttgatattatcatctgctgagggtggagctgaggggtggaaggggagtgagctgacgctcggaaggtgtcttgagattatcatccgctgagggtggaagcggcccccgcagacgctcggcaggtgtcttgaatattatcatctgctgagggtggaagggcagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggccccccagacgctcggcaggtgtcttgatattatcatctgctgagggt

SEQ ID NO: 276974 - DNA, 1444 bp, Homo sapiens
atttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgcgttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagaagctccgcagacgctcagcaggtatcttgatattatcatctgctgagggtggagctgagggtggaaggggagtgagctgacgctcggaaggtgtcttgagatcatccgctgagggtggaaggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgaatattatcatctgctgagggtggaagggcagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggccccccagacgctcggcaggtgtcttgatattatcatctgctgagggt

SEQ ID NO: 276975 - DNA, 1160 bp, Homo sapiens
atttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgcgttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgaggggtggaagcggcccccgcagaagctccccgcagacgctcggcaggtgtcttgatattatcatctgctgagggtggagctgagggtggaaggggagtgagctgacgctcggaaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgaatattatcatctgctgagggtggaagggcagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggccccccagacgctcggcaggtgtcttgatattatcatctgctgagggt

SEQ ID NO: 276976 - DNA, 234 bp, Homo sapiens
agggtggaagcggcccccgcagaagctccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgc

SEQ ID NO: 276977 - DNA, 278 bp, Homo sapiens
gggtggagctgagggtggaaggggagtgagctgacgctcggaaggtgtcttgagattatcatccgctgagggtggaagcggcccccgcagaagctccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgag

SEQ ID NO: 276978 - DNA, 574 bp, Homo sapiens
gggttttcccttggtggctgatgcgggtagcagctccgtggagttctgcatgatcagtctgcaggactgcagtgccaccccaccggagacctcggccgtcttgtaattctggtgaactgtgatcttgctaatggattttaactgtatttaattaaatgtgatttttaggaagtgaaattgcagatgatctaagtatcttatattcaaatagagcagcatgttacctaaaagaaggaaactgcagtggctgcattcaagattgtaacaggtaaactgcacgttttcaggtttgtcaagagattgttataatttcattatggtgaatgcaatatccaagatcctaaattttctgcctaaggatctaatttcttaagagctttatggtatgttaattgattgatgcataaaaatcataaattatcttacgtatatgaagagagttatagaagattgtgcaaacttttttcatttccactgctaccgccctaattcgtgctcttttcatatcactcctagactactggagaagcctgataactaattccaatccactgcgcatcagcctgtttcctga

SEQ ID NO: 276979 - DNA, 543 bp, Homo sapiens
agaaatgctacactgatgtggggaattttccagacggtcattttctacctcaggaagaatgttaacagtagcaaagcgggtgtgataatcactggaaccatgactacaagaagttttcatgctttctaggtcagaacaactaaattcagaaaaatgactagagtgagaatctgctacagaaggcatactgtcactgagggatggagcctcaaattcacttgagttcgtgctttgttgttctaacaactgtgcatccatgtcctctctcgtctcatttatcttcatgttaccctttttcctcagtttaccactttttgattttttccctgctgttgcttctttggaccacttggtggcactagatttaccttcaggcaagccactggatgaaccgccagcatgacttcgggtggcactgccatcatccacactactgcttccactgttgtgcctgaatttggatggctttgactcaatatctacttgcacctccatactgttgccttctctgaaatataagagtaacaaatacaaacataattg

SEQ ID NO: 276980 - DNA, 4216 bp, Homo sapiens
gtgcggcggccgcgacttccccgacgcggggcgctgagaagcagtgagtgcctgtgtgtacctgccggccgggaatataggacttgtcgcatctcagcccttccctcccggagcgggggcgagaggtcgaggcggggaggcgaaggggcggtgggccgcgagggagaaggagcgatggggtggacgtccttcaaggccggggaacacgcggggctttccaggccgcgggggacggtggcgggtgtcggggcgcggtggcaacgctggagttcccgggtccaccggcgcggtcagccctggtgacccaagccaggggctggggagcaatctgagaccattgcggctgggctgtggggctccccagtcccggcaggtcctggcgccgctgtacatagaaaccgttgccacggcgggaggatgccgtttcttttcggtctccgactgcagggggcggtcggccctgtggatgcaggaaagagggtgcctcggtgggagagacccagcttttcgcgttagtaggcccgagcagtttgaactggagctatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacgcttgtctaaaattgagacaagaatagatacagcaggtctaactgagaaagaaaaggattttcttgccactcgtgaaaaggagaaaggaaatgaagctttcaactcaggggattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagaagcccgcggagccggcgggagccgcgcgcgccgcccagccgtgcgtcatgggcaacatccagaagaagctgactggcaaagccgaaggcggcaagcggccggcaaggggcgcgccgcagcggggccagaccccggaggccggcgcggacaagcggagcccacggcgggcctctgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggaagtgaaattgcagatgatctaagtatcttatattcaaatagagcagcatgttacctaaaagaaggaaactgcagtggctgcattcaagattgtaacagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaatacggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccacgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagatgatgttgacactaattagcaagggccaaaaggagctaattgaacagctgtttgaggacctttcagacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctccaaaaatgtact

SEQ ID NO: 276981 - DNA, 3718 bp, Homo sapiens
gtgcggcggccgcgacttccccgacgcggggcgctgagaagcactatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacgcttgtctaaaattgagacaagaatagatacagcaggtctaactgagaaagaaaaggattttcttgccactcgtgaaaaggagaaaggaaatgaagctttcaactcaggggattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagaagcccgcggagccggcgggagccgcgcgcgccgcccagccgtgcgtcatgggcaacatccagaagaagctgactggcaaagccgaaggcggcaagcggccggcaaggggcgcgccgcagcggggccagaccccggaggccggcgcggacaagcggagcccacggcgggcctctgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggaagtgaaattgcagatgatctaagtatcttatattcaaatagagcagcatgttacctaaaagaaggaaactgcagtggctgcattcaagattgtaacagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaatacggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccacgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagatgatgttgacactaattagcaagggccaaaaggagctaattgaacagctgtttgaggacctttcagacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctccaaaaatgtact

SEQ ID NO: 276982 - DNA, 3546 bp, Homo sapiens
gtgcggcggccgcgacttccccgacgcggggcgctgagaagcactatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacgcttgtctaaaattgagacaagaatagatacagcaggtctaactgagaaagaaaaggattttcttgccactcgtgaaaaggagaaaggaaatgaagctttcaactcaggggattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagatgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggaagtgaaattgcagatgatctaagtatcttatattcaaatagagcagcatgttacctaaaagaaggaaactgcagtggctgcattcaagattgtaacagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaatacggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccacgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagatgatgttgacactaattagcaagggccaaaaggagctaattgaacagctgtttgaggacctttcagacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctccaaaaatgtact

SEQ ID NO: 276983 - DNA, 3465 bp, Homo sapiens
gtgcggcggccgcgacttccccgacgcggggcgctgagaagcactatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacgcttgtctaaaattgagacaagaatagatacagcaggtctaactgagaaagaaaaggattttcttgccactcgtgaaaaggagaaaggaaatgaagctttcaactcaggggattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagaagcccgcggagccggcgggagccgcgcgcgccgcccagccgtgcgtcatgggcaacatccagaagaagctgactggcaaagccgaaggcggcaagcggccggcaaggggcgcgccgcagcggggccagaccccggaggccggcgcggacaagcggagcccacggcgggcctctgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaatacggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccacgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagatgatgttgacactaattagcaagggccaaaaggagctaattgaacagctgtttgaggacctttcagacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctccaaaaatgtact

SEQ ID NO: 276984 - DNA, 2541 bp, Homo sapiens
atgcaacttttatggttctgtactttattattaaatacataggtgcaaataagaattttcattttaatctgtcaacgacaatctgttgaaaccctgctgtgtgccttgtgccatgctgctctgttaggggactggggaggccaggacatgctgccagggagctcccggctcagtgggaaagagtaaatgcagagtgctttgctactggtttaaaagaaaggaacacaaatatgattgctttcttactctgggtttgcctttctggcatgttgcctggttcccaagacgaagtctcggatgtgtacatatttgagagttcagtactgcagtatctattcagtgaagtataaacgaaagagcatttttcaaaacaaatggtatgtaatatttttgtcttctttagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaatacggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccacgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagatgatgttgacactaattagcaagggccaaaaggagctaattgaacagctgtttgaggacctttcagacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctccaaaaatgtact

SEQ ID NO: 276985 - DNA, 2762 bp, Homo sapiens
gtgcggcggccgcgacttccccgacgcggggcgctgagaagcactatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacgcttgtctaaaattgagacaagaatagatacagcaggtctaactgagaaagaaaaggattttcttgccactcgtgaaaaggagaaaggaaatgaagctttcaactcaggggattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagatgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggaagtgaaattgcagatgatctaagtatcttatattcaaatagagcagcatgttacctaaaagaaggaaactgcagtggctgcattcaagattgtaacagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaatacggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccacgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagtttaccactttttgattttttccctgctgttgcttctttggaccacttggtggcactagatttaccttcaggcaagccactggatgaaccgccagcatgacttcgggtggcactgccatcatccacactactgcttccactgttgtgcctgaatttggatggctttgactcaatatctacttgcacctccatactgttgccttctctgaaatataagagtaacaaatacaaacataattg

SEQ ID NO: 276986 - DNA, 430 bp, Homo sapiens
caggaaagagggtgcctcggtgggagagacccagcttttcgcgttagtaggcccgagcagtttgaactggaggtattactaagctggctacgaaatatgggaggtggatgtggatcaggatgatggagaaattaaatccagctaggatcgaaggttttcccaattagaaacaaagactgcaaacagaggtggaagagttctaaagtattgtataacttgttttttggaacttgagatggacattcagtagtcttgagaaggtgtatcctacagaaagaaagaaaaaaagagaatccttttttttcaaaaaggattctcagagagacttggtccaaaggtagtgagttctctcacttgattgttcagttatagatccacctcctcgttgtactctttctccccttctcactactgcacttgattagtcaaa

SEQ ID NO: 276987 - DNA, 464 bp, Homo sapiens
acatttctctttactgtgaatggtgccatttatggtctgtaagtgtttgtgtgggtaagttttgataaattttaactttttataacttgtgtatactttatggtagtaaatgataaaacagactagtatctacatatattttatgcattcatgaaatacctaactttatcttaatttttttgatatttctaattcatctgtgagttttttcaaatcgtcacaaatctccaaaaatttttccaatatttttactgaaaaaaatccacatataagtggaccaatgcagttcaaacttatattgttcaagggtcaactatagttctttcttatgcttggttataattatttcaaactatatatttacccttttctctattctcagagttgggtatcagaaattaaaaaagaagaagataaaatgcactttcatgaaactgagacatttccagcaatgaaagataatt

SEQ ID NO: 276988 - DNA, 348 bp, Homo sapiens
cttagtagagacgggggggtttcaccatgttggccgggatggtctcgatctcttgaccttgtgatccgcctgcctcagcctcccaaagtgctgggattacaggcatgagccaccgtgcccggccaaaagggaagattttataaaaatctagacaagtaagatgcaagacaaaaaaaaagaaaagaaaagaaaagaaaattagaccatcaaagattatgacttacaggctgatccaaaggtagtgggttacctcaactgattgttcacagtcagttatagattgaactccttgttctacttttttccccattccttactactgcacttgactagtcttaaagaaaaaaa

SEQ ID NO: 276989 - DNA, 256 bp, Homo sapiens
tccacaatatttgtatgaaagaaaaacagcatttttctctagcagagaaattggaactcaattggaagatgaagactagtcagttcaagctagcaacaatggcaatggtttggtggggtgggaggatcccatggtgtgatgcaggtctgagccctggccgtgctggatgtggtcatgagcttcgtctagtcatcagtctgtctcctacatgccagggatcccaccaggaggcatgtgagtttggatggggaggcaa

SEQ ID NO: 276990 - DNA, 631 bp, Homo sapiens
aaatcattgttgctgcaaatggtaattgcatggcaatcttcttacttagttctttgattatcattctatatatcattctaatatatacattatatattgtattatataagattatcattttattttatattattattctattatatattactctattattttactcccacatcctcttttcttgccatgtttttaatgaatccttctggatatttaaaaattacataaattagccaggcgtggtggcttatgcctgtaatctcagcactttgggacagcaaggctggaagatgcttgagcccaggagtttgagaccaacctggccaacatagtgagaccctgtctctactaaagatgtaaagattttaaaatttaaagtgatggctcacttctatagtcctggctattcaggaggctgagatgagagattgcctgaatccaggagttccaggttacagtgactatggttgtgccactgaactccagcctgggtgacagagcaagaccctgtttctaaaaataaataaatacaataaaataaatttaaaaagagtaaagaaagattaagcttgaaaagctaacttggagtcagaacctgcccatatgacttttcctcaggccattgtttccc

SEQ ID NO: 276991 - DNA, 428 bp, Homo sapiens
gggcctctcgagcctggtgggtgtgacatgggggttggccatcttcaccccgttgggcctctccaccgtctacatctttgcacttttcaactccttgcaaggtgtcttcatctgctgctggttcaccatcctttacctcccaagtcagagcaccacagtctcctcctctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggtttgcaaggctctaaag

SEQ ID NO: 276992 - DNA, 1923 bp, Homo sapiens
ggcattgacccatagcctggtcctgcattacggtctctataagaagatgatcgtcttcaagccataccaggcctcccagcatgacatgtgccgcttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 276993 - DNA, 1583 bp, Homo sapiens
ggacatctcttccacagacctcaacgtgagaactgctctagtttctataaactgtaaacctgtggtggtctgattatcctgatattggattttcttgttttctgttacaccttgagtcatttgcctttaggattctagacagacctaagggaaaaagaactgaaaacatattttgcccccacccccacaaaaaaaaatactgaaaactcccccccgcctcagttacacatccaaactctacatttacaaaacgaattcagggtgaggaagtaaaaacaggtcatctattcacaaaactgaaatacttcttccctggcacgtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 276994 - DNA, 2171 bp, Homo sapiens
gggggaggagatgagcatggagagaactgggaataggagattccaaggaacagggcaggtggatcagggctcaaagttgagaaggtacgataggctgagctggaggtggaaaggaaaagaagtggtcttcagggggctcatttgtaataacttacctggttaatcggagtctctctactgacttaaggattgtgggatgaggggaatgctatgtttggcttcatatagtctccaggactgggttcagtatgggtggtctgagcctgtggagtggggctgaccctgcctgggttcatcttgtgtctccatcccgaggtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgtacctttcgcctttctaggaatgttaattcttgctagtttcctatttatgaaaggagagggaaatgggcatgatgatgcatgtaataaaagcatagttaacattcattcagcacttatccta

SEQ ID NO: 276995 - DNA, 934 bp, Homo sapiens
attttaaaatttttattgagacacagcatataaagtatacccaaatcttaagggtataacataatgaatttcactatcaagataaagatttagaacatttatagttttcttgtgctcctttcaggcaatacctaaaggtatttaccttgtcttttgataacctcctccacatcttcctctggttccttttaacagggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggtctgggagcagggacttcagcctactttcaataggcttgctggggaggtttaaaagggaaaaagtaaatgggaaggtattagtttaattgcctctggcttacctcctttagtctgctacaatttcctcactcttttctttgttatttttaatgacaaaagtaacacgtatttattgcaaaattttaaaacagcaccaaaatatggtgttggcgttcacacaatcccagacctattccacaggagtaaccactgttaatagtttttattgttttggatagacctttttctatagattgcaaatatactattctgtatgtacatataaacaaacacatatacactcatttaca

SEQ ID NO: 276996 - DNA, 859 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtgagttccgccgcctcggccgggggttggggggtggggcgagctgtggccgtagggataggtgggctggactgagtgcatgaagtgcgacccgcccctagagtatcggggagctggatagaagtcaccaggagtaccttgaaagtgcagggtgttgggggtggcgtcctctgcttaatggaaagtactttctcacctcaggtcggccaccctctgactgtaggcacactagcccttggcctagggttagcgtgatgtggggctggtttgaagacagaaggtgtgttcctcctctgcattttagagtgtggatagggccttggcctcaggaattagggttaggggagcggatatcactgtatcagggtgtgaggtttaccctcagttcccactcctcttttaccacctttctttacctccaaggagctagggctccagggtggaacgatgctgccgtctttgtaaatgtgtatgtgcgtgtggaacagaggcgatattttagatattcctttttcagcctggaatacctctacatggttctgcttaatcgctatccagtttttcatctaccagacatacacatgctgtcttcccagcttggaatttatggctgtgatatgggatagtaacagttaagcc

SEQ ID NO: 276997 - DNA, 211 bp, Homo sapiens
tagccatgtgcggtgggtgtgcctgtagtcccaactacttgggaggccgaggcgagaggatggcttgggcccaggagtttaaagttacagtgatctatgatcagcagcctgagttgacagggaggatatgaaaatgttctgttctcacttttggctttatgtccattttaccactgtttttatccaataaactaagtcggtattttttgta

SEQ ID NO: 276998 - DNA, 1936 bp, Homo sapiens
cgaggcagactgcttagtagagccgggttaggggcgggcgggcggggattgggggctgtccgcggacatggcaagacgtggctatttctacgaccgacgtgggcagattccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 276999 - DNA, 2919 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgtaaaaaaacaaaaaaaaaaaaaaaaacaaaaacacaaaaaaacaaaaaaaaaaaacaacaacaacaaaaagaaaaaacaaaacaagcaaacaaaagaagagagagggggcgcgcgcgcgccgcagcgactactctctcctcccgggaggcggcgcccccggccgccgcgcgcgcgcacccccacgctttgttgcgcgaacggacggcggcggcgccctcagggggagcggcgcggtatattatattgaccgcgtgggcgcgcgcgcgggcgccgcgatttatttatacaaagagacatacgagatggtgcggaggaaaaagaggggaacaccgagggaggatcatcattgctagtacgagcacgacgacctccttctctgtgcgttgcgggggcggcggagacagcaaaacgcgcgtggggagcaacagtcacccctccgacgagcgcgcgagggagattatatagagcggcgcctcgcgagggggggatctatacttccacagcagatcttattgcagcgagcggatgtaaagaggggcgtggggacaaaacaaacacagggcagcccattacttagcggtgccgccgcgcgcgagtgcgagacaactctattgtgagagcttcagtagtggtgaattatataatctagttcttgcgcctaccttactgtctatctcttacctcaccgagggacccactcaatcgacccccacaaacatccacccccaccccacacgacaacactccacaccacacaaccaaacagcgaagaacgaagggagcggtgagggagtaaaaggggagagggaggagagcagggggagggacgggatgagatggtagtggatgcggaggcggagatggagcggcgggacgagggagttccgagtagggtcgggggaagggagagcggggaggtggtaagggagcagacgaggccagaaggccgaaacataaagcggaa

SEQ ID NO: 277000 - DNA, 1813 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatccccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277001 - DNA, 2327 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagtaagtaccgaagtcttccctctgttccctaggccccttctttttctccttgaaataacctcttctgcctggtattgtctgctgttgggccagttgtccttaaggatgaatggccttcagagggaccatgaatctctggaaattgtatgcaacatatcatgtgtatgtgcatttttctgggaaaagtcattggctttcatcagtcactcatagcagtctgggatcccttccagaagtttcagaccagtgatttgattcttttgggtggcccctttcctgggctacatgctcgctcaaccccctttttccttttgttccctgtctccccatccccttggggtgccaggtgcccatctttggccctctcccaggttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277002 - DNA, 1651 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggtctgggagcagggacttcagcctactttcaataggcttgctggggaggtttaaaagggaaaaagtaaatgggaaggtattagtttaattgcctctggcttacctcctttagtctgctacaatttcctcactcttttctttgttatttttaatgacaaaagtaacacgtatttattgcaaaattttaaaacagcaccaaaatatggtgttggcgttcacacaatcccagacctattccacaggagtaaccactgttaatagtttttattgttttggatagacctttttctatagattgcaaatatactattctgtatgtacatataaacaaacacatatacactcatttaca

SEQ ID NO: 277003 - DNA, 1394 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgatgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277004 - DNA, 1239 bp, Homo sapiens
attttaaaatttttattgagacacagcatataaagtatacccaaatcttaagggtataacataatgaatttcactatcaagataaagatttagaacatttatagttttcttgtgctcctttcaggcaatacctaaaggtatttaccttgtcttttgataacctcctccacatcttcctctggttccttttaacagggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277005 - DNA, 1487 bp, Homo sapiens
gcttgaggggtgggcaggaaggactgtgacttaggtgtttgtctttcagatctgtgatattgccattaactgggctggtggtctgcaccatgccaagaagtttgaggtgagtgaggaggtgatgggaaagacagtggccatcctagggtaggtgtttaggatgatggtggggggcagctgggaggggaattgctcttctctttatgagaccactgtcttgccataggcctctggcttctgctatgtcaacgacattgtgattggcatcctggagctgctcaagtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277006 - DNA, 845 bp, Homo sapiens
tgacagtgtctgtatagagtagttccttaatgtttatttgatacgtgaatgggtgaatgaatagcagtctctaccaacaagaggaggagtggttctcaacggggcctgagaaatggctttggaaaagggtgctgggagaagattagaacttagagtgagatcctgacctctctccccttgctttgcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277007 - DNA, 1679 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccaggtaatactgtcagttcctcctcaggagtgttctgcctgggcttggggaaagagagcaagggaagaggaggttctttaggttggtggtggaaggggtatctgtgatgttctgatcagttctgatcactgcactttcctggggttttgctttttgcagtgtgtggagctgactctctgggctgtgatcgattgggctgctttaacctcagcatccgagggcatgggtgagacttgctctccttcttctccccaaggtttttaagtggccttggacttcagtacgtgggtgggggtagttggggaatgggcctcacctcttcttggaaatcaaaaatagctacaaattgtacttgaactagaaatgtcatcttgaacagggttccctagatggtcattcattcacgatatatttttattaagcacctgttatgttccaggcatcataccacatcatggggatggaataaggagtctcccatggagtttacagtttaggaaacagacaaaaaataaataatcaaatgaaataaatagattcttataaattctgtgaaagaaaaaaagaaagctgagacacaggatacaatgggggacctacttgagatagcatggtttcggaaagtttttctgaggaagtaaaatttgagttgagacctggagactaagaaggagtgagtcataagaggagcagagagaagcctgacccaagcatggacaaaggcccacaaaaggctctgagggctgggcccagtggcacacacctataatcccaacacttccagaggccaaggtgggagaatcgcctgaggctaggagtttgaggccagcctggg

SEQ ID NO: 277008 - DNA, 359 bp, Homo sapiens
ctgttattgactaggaggcagtccagtttaaagtagaggcagttggggttggtggggagggagagctatcagttgggggacctgaactagaggtaccactgagatgaaaaccagtatggtaggggtaaaaggcagctaggagattccatgtcctgggaatctctggaaactgctcactctgtattcctcatttccaaccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcag

SEQ ID NO: 277009 - DNA, 354 bp, Homo sapiens
ctggtggtctgcaccatgccaagaagtttgaggtgagtgaggaggtgatgggaaagacagtggccatcctagggtaggtgtttaggatgatggtggggggcagctgggaggggaattgctcttctctttatgagaccactgtcttgccataggcctctggcttctgctatgtcaacgacattgtgattggcatcctggagctgctcaagtaagtagcccaggaggagatgggggcagttacgggattcttggctgaggaggtctctcagtctcaaccctgaccttgacctccctcctccctgattagcttctcccaagttcttgatgctttattcaggctgcctcttccactgc

SEQ ID NO: 277010 - DNA, 432 bp, Homo sapiens
ttaagtgcttctttacttcccatccagtgccttgcacagggcttggtacatggtttggtccaaaatatttgttgaataaatttgcagatagcccacgtgtgtaggagagggagagaaggttcttgaaaaatggagattggaggaatctaggatggggagggagatatgggaagggcccagacagaggcaggagggttccaacttgttcctcttccctgcagcccagtgtttcccgggctctttgagttctgctcgcgttacacaggcgcatctctgcaaggagcaacccagctgaacaacaaggtgacatagtcccgagtcctgttcttcctttcctctggatccctggactcgggatttaaccctgatcctgggctcccagcttgaggggtgggcaggaaggactgtgacttaggtgtttgtctttcagat

SEQ ID NO: 277011 - DNA, 1956 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277012 - DNA, 2076 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgtacctttcgcctttctaggaatgttaattcttgctagtttcctatttatgaaaggagagggaaatgggcatgatgatgcatgtaataaaagcatagttaacattcattcagcacttatccta

SEQ ID NO: 277013 - DNA, 758 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggacatgttgaagtcggggcagagagtggcaatatcacagatcttgtgctcagctggggatcctcga

SEQ ID NO: 277014 - DNA, 1996 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgtaaaaaaaaaaaaaaggacgccgctcgcgatctagaactagt

SEQ ID NO: 277015 - DNA, 2051 bp, Homo sapiens
gggggaggagatgagcatggagagaactgggaataggagattccaaggaacagggcaggtggatcagggctcaaagttgagaaggtacgataggctgagctggaggtggaaaggaaaagaagtggtcttcagggggctcatttgtaataacttacctggttaatcggagtctctctactgacttaaggattgtgggatgaggggaatgctatgtttggcttcatatagtctccaggactgggttcagtatgggtggtctgagcctgtggagtggggctgaccctgcctgggttcatcttgtgtctccatcccgaggtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277016 - DNA, 2114 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccaggtaatactgtcagttcctcctcaggagtgttctgcctgggcttggggaaagagagcaagggaagaggaggttctttaggttggtggtggaaggggtatctgtgatgttctgatcagttctgatcactgcactttcctggggttttgctttttgcagtgtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277017 - DNA, 1897 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277018 - DNA, 1649 bp, Homo sapiens
gggggaggagatgagcatggagagaactgggaataggagattccaaggaacagggcaggtggatcagggctcaaagttgagaaggtacgataggctgagctggaggtggaaaggaaaagaagtggtcttcagggggctcatttgtaataacttacctggttaatcggagtctctctactgacttaaggattgtgggatgaggggaatgctatgtttggcttcatatagtctccaggactgggttcagtatgggtggtctgagcctgtggagtggggctgaccctgcctgggttcatcttgtgtctccatcccgaggtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277019 - DNA, 1060 bp, Homo sapiens
agccccagaccccaactgcgtcactgtgacggggctcccagagaatgtggaggaagccatcgaccacatcctcaatctggaggaggaatacctagctgacgtgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgta

SEQ ID NO: 277020 - DNA, 1077 bp, Homo sapiens
  misc_feature (983)..(983): n is a, c, g, or t
  misc_feature (986)..(986): n is a, c, g, or t
  misc_feature (988)..(988): n is a, c, g, or t
  misc_feature (998)..(998): n is a, c, g, or t
  misc_feature (1001)..(1001): n is a, c, g, or t
  misc_feature (1010)..(1010): n is a, c, g, or t
  misc_feature (1012)..(1012): n is a, c, g, or t
  misc_feature (1066)..(1066): n is a, c, g, or t
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactatanganantaggcaggtnaanacgctctanancagagttgttatctcctcatggcttctttcatcagtgggtcatctttcctcttntcttcattatg

SEQ ID NO: 277021 - DNA, 2050 bp, Homo sapiens
cagcacgcacggcacggggtggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccagcatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagtaagtaccgaagtcttccctctgttccctaggccccttctttttctccttgaaataacctcttctgcctggtattgtctgctgttgggccagttgtccttaaggatgaatggccttcagagggaccatgaatctctggaaattgtatgcaacatatcatgtgtatgtgcatttttctgggaaaagtcattggctttcatcagtcactcatagcagtctgggatcccttccagaagtttcagaccagtgatttgattcttttgggtggcccctttcctgggctacatgctcgctcaaccccctttttccttttgttccctgtctccccatccccttggggtgccaggtgcccatctttggccctctcccaggttacaagcaccttttccagccggttatcaaccaggtagtggacttctaccaacccacgtgcattgtgctccaggtaatactgtcagttcctcctcaggagtgttctgcctgggcttggggaaagagagcaagggaagaggaggttctttaggttggtggtggaaggggtatctgtgatgttctgatcagttctgatcactgcactttcctggggttttgctttttgcagtgtgtggagctgactctctgggctgtgatcgattgggctgctttaacctcagcatccgagggcatgggtgagacttgctctccttcttctccccaaggtttttaagtggccttggacttcagtacgtgggtgggggtagttggggaatgggcctcacctcttcttggaaatcaaaaatagctacaaattgtacttgaactagaaatgtcatcttgaacagggttccctagatggtcattcattcacgatatatttttattaagcacctgttatgttccaggcatcataccacatcatggggatggaataaggagtctcccatggagtttacagtttaggaaacagacaaaaaataaataatcaaatgaaataaatagattcttataaattctgtgaaagaaaaaaagaaagctgagacacaggatacaatgggggacctacttgagatagcatggtttcggaaagtttttctgaggaagtaaaatttgagttgagacctggagactaagaaggagtgagtcataagaggagcagagagaagcctgacccaagcatggacaaaggcccacaaaaggctctgagggctgggcccagtggcacacacctataatcccaacacttccagaggccaaggtgggagaatcgcctgaggctaggagtttgaggccagcctggg

SEQ ID NO: 277022 - DNA, 356 bp, Homo sapiens
ggatttagaaaactcataccttaactgataagctagggttgtaaccttatgccagtgacatcaatgttcacaataggtgaatatgttgtaaaaataagagccaataagtattatttcacagcctaaattaaaaagtccctgatctgtttttccaggaacaatcttgtcttagtgatttggtaaggtcttggtaacatctggaaatctactttataaatcactttatgattcactttccttattctgcatattatgttaacataacaagttatgcaatgttagcattcctataaatatatttataggtttctaaagggatcttaattgtaaatatttatcctcattagagggtaagt

SEQ ID NO: 277023 - DNA, 554 bp, Homo sapiens
aaaggtgtgcatgatgagataccaacttatcagtatattatcttggacaaacttactcttcatttggctgttaaatgcaggaaataatagtacagattaattctcccccttccacaaatacatacatatatgcatgcaaagaagtgtatgcagaggccatggctgttgcttagtctggaaagctttttcaatctgaaggctctgtcttctcttgctatggtggtgtttacctctagctctctcttcaattcaattttttgctcatgcagggagcactggtcagagcacaaggatggagaactgctttatttcaccctcaggtttgtttcttgatttatttatagtatttttgagtgtatctctttgggtagttttcttagtggttgctataggtattacagtattcatatgtgacatcacagtttatttttatcaacattttactactctgagtaaatgtcaggtagtaaactctccatttacaccctctgccttccccacttttaagtatcattgtctttgaatattggatggtgttctaattattgcttcaa

SEQ ID NO: 277024 - DNA, 743 bp, Homo sapiens
gctcccgccgcccagccggtgatcgctctccggccgtccccggcaccctcggccccccacggcggttggtccgggcgggggaaggagaaagtgagactcggtgtcatcaccaatccgtcgccagaaggggaggaaactggaatccagcagcggcgagcagcagctgggcggtcacatctggaaatggaaagccgacctccccctcctcctccacctcctcctcctcctcctccttctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggaccccgcgcccccttcccagttctctgaccgcgacgtgtgtgtctggggcagctactagctttgagggcagaacccgcgtggcccgagcgggggtctaggcgaaggggcagtgcgtggtatttccagccccgcgtagtgcccgaagcctgcaagcacgcctcctgggttccagcagcggcggcagagcggggttggttggacccgccaggtttgcgtaatgggctgagccgccgg

SEQ ID NO: 277025 - DNA, 996 bp, Homo sapiens
gctcccgccgcccagccggtgatcgctctccggccgtccccggcaccctcggccccccacggcggttggtccgggcgggggaaggagaaagtgagactcggtgtcatcaccaatccgtcgccagaaggggaggaaactggaatccagcagcggcgagcagcagctgggcggtcacatctggaaatggaaagccgacctccccctcctcctccacctcctcctcctcctcctccttctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggagtgaaggcaattttgaaggcatgactacgacctgctctggccacaagagctaagagttgccaggtgtggtggctcaaacactttgagatgccaatcccaacactttgagaggccaaggcaggaggattgcttgaggctaggagcttgaaaccagcctgggcaacacagtgagaccccatctctacaaaaaataaaaaaacaggccaggcgcagtggcacttagggaggccaaggtgggtggatcacctgaggtcaggagttcgagaccagcctgaccaacatggagaaaccccgtctctacaaaaaatacaaagtttgccagtgtggtggcacatgcctgttatcccagctactcaggaggctgaggcaggagaatcgcttgaacccgaaaggcagaggttgcagtgagtggagatcacgccattgcactccagcctgcgcaacaagagtgaaactccatctcaaataaataaataaaataaagttttaaaaagtcaaaattatccaggcgtga

SEQ ID NO: 277026 - DNA, 516 bp, Homo sapiens
gctcccgccgcccagccggtgatcgctctccggccgtccccggcaccctcggccccccacggcggttggtccgggcgggggaaggagaaagtgagactcggtgtcatcaccaatccgtcgccagaaggggaggaaactggaatccagcagcggcgagcagcagctgggcggtcacatctggaaatggaaagccgacctccccctcctcctccacctcctcctcctcctcctccttctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagatttcagatactcagactccacctttacttttacct

SEQ ID NO: 277027 - DNA, 1256 bp, Homo sapiens
ttaggctaggtacgaggccgggtgtgaatcggccgagggaatatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatct

SEQ ID NO: 277028 - DNA, 2783 bp, Homo sapiens
tgcgcagttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagtgccaagacccgacgcattagacaatgagagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatct

SEQ ID NO: 277029 - DNA, 2565 bp, Homo sapiens
  misc_feature (28)..(28): n is a, c, g, or t
ctttccgggaatcaaagcgtcaaggacnaagtttgtcctccttgtacctaaattcagatttcaacctggtgagccaagaagaaagtcatgcttcacctccaaagcacctgggcctagtcactccccaaaccccatttaaaaccggaagcactggctgcctgcacagcaagatggggggaccctcaacaccctcctttcacagctcccccttctctctcccatagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatct

SEQ ID NO: 277030 - DNA, 1396 bp, Homo sapiens
tgcgcagttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagtgccaagacccgacgcattagacaatgagagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcaggtatcttgagtgtgggagctgcttcactgtccagttttctttagctaccttttaaccatccgacagctcacatttaggccataaccaggtttgaggccttagactccccttgttcccaagacaaggagagaagtgagactttgttcctagatctcaatttttttctttatcatatcattcctgtaatcaacctaggtctcaattagagcctgatgcccagcaccgctcttccgtatctctttttaccctaccattatggaagaacttctggagctagtatgatcatcttttaaacagcccagttcacccttgggtctgtgcagtatgtgtatcctcctaccactttgaaaaattatctctggatcaattatttgccttaaagtaagtgggtaattgactcccccaagactgcttttcttcctgtgcttaagaggttatgaatgagtgttttctttgggagagcagcctaaaaggggtcaagattttttttgttgttgttactttcacatgtattgattaaa

SEQ ID NO: 277031 - DNA, 948 bp, Homo sapiens
tgcgcagttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagtgccaagacccgacgcattagacaatgagaggtatggaacactaattaaatccctttttgttgctctgattcattctcttgtaatattctggttacatgttgttaaccccatgttctggacacacagtgtaaactgagaacctaggctgttccaaatgatcattttaacacatcctaaagttcaggcagcaatatgttgagatggcctgtgtcctctgatctttacaagagaagtttctgaaaaagaagcattacagtgccccataacctgacatgccagggaatcagctgcattattcagtcccagtgagaaaacttaaaggcagctaacttcatttgtctcctggcttttataccaggtcatttagtgttttctgtgacctctggctatttaaagttcccggtcagaaaacacattggttcctggcatcagcaagtcaaagccaaagattcctcttgtgtcttacagctcaagtattaataggttggggaaaagacaacagtaatagccgataaaaaaggcgacactgtgtcata

SEQ ID NO: 277032 - DNA, 3725 bp, Homo sapiens
tgcgcagttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggttttttgccctgacatctcttcgtcttgtgtttttacttgcatttggcttgatgatcattgtgtgtattgatcaatggaagaacaaaatctggcctgaaataaaagtgccaagacccgacgcattagacaatgagaggtatggaacactaattaaatccctttttgttgctctgattcattctcttgtaatattctggttacatgttgttaaccccatgttctggacacacagtgtaaactgagaacctaggctgttccaaatgatcattttaacacatcctaaagttcaggcagcaatatgttgagatggcctgtgtcctctgatctttacaagagaagtttctgaaaaagaagcattacagtgccccataacctgacatgccagggaatcagctgcattattcagtcccagtgagaaaacttaaaggcagctaacttcatttgtctcctggcttttataccaggtcatttagtgttttctgtgacctctggctatttaaagttcccggtcagaaaacacattggttcctggcatcagcaagtcaaagccaaagattcctcttgtgtcttacagctcctgctttcatttctcagttcatccactccatttgtttgatccaaagaattttctctgctgtggtttattttggttttgctttatttattttctttctaaggggcacatccaccatttcctcccccttagcagcagtggtgtcagtcagactatgctcacttttatccctggattgcaatcacagggaattggaatggtctgagtgcaaggaagaaaacgtttctaagcacaaagggccttggagctggggacaggtttacacacgtggattgggctgcttgctcatagggtggagttgtcagaacaagtttgtcctccttgtacctaaattcagatttcaacctggtgagccaagaagaaagtcatgcttcacctccaaagcacctgggcctagtcactccccaaaccccatttaaaaccggaagcactggctgcctgcacagcaagatggggggaccctcaacaccctcctttcacagctcccccttctctctcccatagctggggctttgtgcaccctcggttgctcagcgtgcccgagctctgccaccatgtagctgaagtctgggttagtgggaccattttcataaggaatgttttgcttttcaaaaagcaaaacccaggcaagttctgcttgctgagctgtgggatactgacctttttggctgtcttgggccgctacgtccctgggcttctgctgtcctacttgatgcttgtcactgtcatgatgtggccccttgctgtgtaccaccgactgtgggatcgagcatatgtgcggctgaagccagctctgcagcggctagacttcagtgtccgtggctacatgatgtccaagcagagagagagacaattacgccgcagagctctccacccagaacgagccatggacaaccacagtgacagcgaagaggagcttgctgccttctgtcctcagctggacgattctactgttgccagggaattggccatcacagactctgagcactcagacgctgaagtctcctgtacagacaatggcacattcaatctttcaaggggccaaacacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatct

SEQ ID NO: 277033 - DNA, 1832 bp, Homo sapiens
gtgctctagaggatccttcgggagccttaccctcacctctaacggaaggctctgaagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatct

SEQ ID NO: 277034 - DNA, 599 bp, Homo sapiens
ttcgtccagcagcatcttgtactagtcctgactggttagtatagaaacagcactcctcttctaaaaagatacacaggccgcctttctcggcagtgaggagatctaaacctcgatggttttgaagtgtcactgctgcttaaagagtcttttggaattggagagcaagtctatttgggattggagaccccttcgtggggttttgggagggcctggtcggcttgttggcagaggagatagctcatgagggagactgttgggaggtattctcctagctgagagttagaagggggcctgttttgtaagaggaaagggcgtccgtatattaactcaaatggactgaggaaggagggtgcttttggactggctctaatgctctccagtgctatgggcaaaagggaggtccatggtttttggacttcaagagtgagtttggttaactgagccttaaggatcccattgccctttcgacttttccggatgtctggggccagcatgggatatggagacgccactggatgccaagggactgagaaacctgttgagtgatttgggagatgaagctaggggccattgtctgattgtatggagccagggagacc

SEQ ID NO: 277035 - DNA, 3570 bp, Homo sapiens
aatgaaatgacagaattgatcattaggatgcttgttactcaaaaagcccattttttaaagaaggatgtattaaaattattccagcatgctaatgtggcacactcctctgctgcctaacggcaggtgttgctattagcagaggaagccttgttctaagaattattctagagggccagaaagaacaggtattgctccacccgagtaaacgctgactcaactctgcagggctggcgcgctctttcctcacctcacccctcctgccaggcacaactgagatccagaaataagaggattagcgagagaaggggaaatatgcaggacggtagtgatgggtatgcacaaaggagtgccaagcagttttaaccgttaatgttcttcgtctattgctagagaaaatgtctttccttggaggaggcattggcacgagttactataaactccctctgaatctcaagacttctgggacgccgattccgctcctggcctggggcaaggcgtgggagcttggaagccagcgctgcgctccccgtgggaagcgatcgtctcctctgtcaactcgcgcctgggcacttagcccctcccgtttcagggcgccgcctccccggatggcaaacactataaagtggcggcgaataaggttcctcctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccgcctgcacttctggctcggaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacctgacagccaagaggctcctacatgtgaagggtcgtagagtggtgagagccacagaagttccccttagctgggacagtttcaacaagggtgactgcttcatcattgaccttggcaccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaacac

SEQ ID NO: 277036 - DNA, 3748 bp, Homo sapiens
aatgaaatgacagaattgatcattaggatgcttgttactcaaaaagcccattttttaaagaaggatgtattaaaattattccagcatgctaatgtggcacactcctctgctgcctaacggcaggtgttgctattagcagaggaagccttgttctaagaattattctagagggccagaaagaacaggtattgctccacccgagtaaacgctgactcaactctgcagggctggcgcgctctttcctcacctcacccctcctgccaggcacaactgagatccagaaataagaggattagcgagagaaggggaaatatgcaggacggtagtgatgggtatgcacaaaggagtgccaagcagttttaaccgttaatgttcttcgtctattgctagagaaaatgtctttccttggaggaggcattggcacgagttactataaactccctctgaatctcaagacttctgggacgccgattccgctcctggcctggggcaaggcgtgggagcttggaagccagcgctgcgctccccgtgggaagcgatcgtctcctctgtcaactcgcgcctgggcacttagcccctcccgtttcagggcgccgcctccccggatggcaaacactataaagtggcggcgaataaggttcctcctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccgcctgcacttctggctcggaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacctgacagccaagaggctcctacatgtgaagggtcgtagagtggtgagagccacagaagttccccttagctgggacagtttcaacaagggtgactgcttcatcattgaccttggcaccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaacac

SEQ ID NO: 277037 - DNA, 3595 bp, Homo sapiens
  misc_feature (3143)..(3143): n is a, c, g, or t
aatgaaatgacagaattgatcattaggatgcttgttactcaaaaagcccattttttaaagaaggatgtattaaaattattccagcatgctaatgtggcacactcctctgctgcctaacggcaggtgttgctattagcagaggaagccttgttctaagaattattctagagggccagaaagaacaggtattgctccacccgagtaaacgctgactcaactctgcagggctggcgcgctctttcctcacctcacccctcctgccaggcacaactgagatccagaaataagaggattagcgagagaaggggaaatatgcaggacggtagtgatgggtatgcacaaaggagtgccaagcagttttaaccgttaatgttcttcgtctattgctagagaaaatgtctttccttggaggaggcattggcacgagttactataaactccctctgaatctcaagacttctgggacgccgattccgctcctggcctggggcaaggcgtgggagcttggaagccagcgctgcgctccccgtgggaagcgatcgtctcctctgtcaactcgcgcctgggcacttagcccctcccgtttcagggcgccgcctccccggatggcaaacactataaagtggcggcgaataaggttcctcctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccgcctgcacttctggctcggaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacctgacagccaagaggctcctacatgtgaagggtcgtagagtggtgagagccacagaagttccccttagctgggacagtttcaacaagggtgactgcttcatcattgaccttggcaccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctaccanaaaaaaaaaaaaaaaaaaaaaaaaaaattttttggggcgcccgggcccagaaaaaatttttaaaccctttgttggggggcggggccccttttgtttttgaacggggcaaaggtggcccaagggaactccgcgggcatattggggtgtggtttctccaccaaataaaaaaagcgccggggcaaaggggggtgtttgggaccaaacccggaaggagcttcgcgggccactacagggatcaaacacgggagtgcccaggggcggaataaatagccccgccggtcagaggaacacaaagaagacagcgaaacagtacagcgggacaagaggaccagcagacagcacttgcacaagagaccagaggacacaacacaagacaaagcagcacgacgagcacagaaccaaacacgtagaagaacaagagaagaagaggacaacgacaaaagagcggagaa

SEQ ID NO: 277038 - DNA, 2554 bp, Homo sapiens
ttcgtccagcagcatcttgtactagtcctgactggaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaacac

SEQ ID NO: 277039 - DNA, 2217 bp, Homo sapiens
aatgaaatgacagaattgatcattaggatgcttgttactcaaaaagcccattttttaaagaaggatgtattaaaattattccagcatgctaatgtggcacactcctctgctgcctaacggcaggtgttgctattagcagaggaagccttgttctaagaattattctagagggccagaaagaacaggtattgctccacccgagtaaacgctgactcaactctgcagggctggcgcgctctttcctcacctcacccctcctgccaggcacaactgagatccagaaataagaggattagcgagagaaggggaaatatgcaggacggtagtgatgggtatgcacaaaggagtgccaagcagttttaaccgttaatgttcttcgtctattgctagagaaaatgtctttccttggaggaggcattggcacgagttactataaactccctctgaatctcaagacttctgggacgccgattccgctcctggcctggggcaaggcgtgggagcttggaagccagcgctgcgctccccgtgggaagcgatcgtctcctctgtcaactcgcgcctgggcacttagcccctcccgtttcagggcgccgcctccccggatggcaaacactataaagtggcggcgaataaggttcctcctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccgcctgcacttctggctcggaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacctgacagccaagaggctcctacatgtgaagggtcgtagagtggtgagagccacagaagttccccttagctgggacagtttcaacaagggtgactgcttcatcattgaccttggcaccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaagtatgtgtgaaactgaactggctagaaaaaaatagaaaacattggagctcatgacatctccacgaaactcatgaaaaagtttgggtcaaagtaacgtctgtatgtgaagtgattctccacctgcctgtctgctgcaatctggtgtccctcttctttatctgcgtgggggttagaattttttagaaactgcacatcagactttccatagagctgcccattcacttcctccacagcctttaattcaagatagtaaaccacagtaggtttagctaagagcacttaagagttattattccttagagcaagttgtgcagacttggcctgaaacccagatgatatttgtcttcatcgaaatcaatttagaccctggctagttactcctttcctttccgaatctctcagcctcatctactctcctcatttttatgtccctgcacaaggaacacaatgagatcatttcttccaggtcacagagctcttgtgaaccttatgtagaaagacaaacttattttactgcaggggta

SEQ ID NO: 277040 - DNA, 2278 bp, Homo sapiens
  misc_feature (1)..(1): n is a, c, g, or t
  misc_feature (671)..(671): n is a, c, g, or t
nggcacgagggacaggccttaccaagattagcggtgtcaattaaggccaaacgggtgccctctggtgcagtgcctggcccgcagtaagcgtgctctccaacaagctccctccagccctggtggtgagcatgacagcagcatgctctgaacctcatggagagtcccagcacgccttctccccatcccaaattatttctaacacaggtacgccagtgaggtgtgtgtttgctgcctgggtgacatgagctaccatcgtctacaagtctttgtttggtccttatgggaacaatgcattctgtggccatagtagggaatggaaagggcaaggtcattaaaggaaaatcagcatcccatgtgctagcccactctacaactcaaatgaattcagaacctcacagctgggccagaacaccccacgaccagtgcttcccattcagggtagagcatgggagagaaggagagccccgaagccagcctggggcacatgatgccactattagaagggtgtccaacagcactgatatttcttatctctcgcccctttgtctagggccttgcaccctgtggcaggaatcctggtaaaacatggcctttcttggtcaagttggaggggaccagttgtgaaagaaaaaaggaagagagtgtaggtgtgtgcccaggcaggtgcctcntgggaaagctgcctggacagtgagctctgcacgtgagtctcacccaagctgctgtgccaagtccccaggaagtgggcacaccaaagccacctgaggtcatggggttagcacctgccccagggcagcctccctccagcattcctgcagctctctggactttggcatcctcttttgacctctgaacacttccctttctttttaactttgtcatgtgcagccatctacatttctgaaatatagccagcattttaaacattacagagggagacagttttctgagttctctagacagccatgttgccagagatgatagtgatgggtagttttataaaaggttttgaatcactgctcattggagagggcatgaagaagccaaaagtggacaaggttgaatcctgaagcagcaaacgttagaaagagtcatatctatggaggcttcaggtatcagggatgattgtggtccaggcattgggtcaaggcaagtcccacatcagatggggaaattgaggctatagccctgtacccactcagactcctgagtaccccaggtcggggggatctgaggcagtggctggagccagcagcctgccctccagctagactgcatttctgctctttcctctgcccttccctcttttagttttccgctcttctttctctttttccattctcatcttcttctctgtcacatctcagacctgcccaaggagggctggtagcatctgaagcacttggggttgcaaaggacctgccatgtgtgaggggttgccacaggcccctactccaccacatcaagggctttgctgtccgcgaggatgttctgagacatggggctcaccctgcctcccttgggtcacaccttttggtgcatgtccatgacttatttggtgctcagttcgtggtcaggaatgcagcctcacagtgacacatcgttcttgtggaacaacatgatctgatctgtgattcagtttccaggagttcctggaaaaaaaagaaaaacagggactgcgtggaactcttcttctggactccaccaggggccctgagagcacagttttgacacaggtgcagtaagttcttagcaactgaagcccttacaaagtagcaaagcattccatgctgggaaacttcattttaaaaacatcttgtttgagaaacgagttaggagtgttcccaacttggcttccagctaatgtaaacactgaaaacaaattaatcatttggagaaagagaacaaggagtttaatgttttgaagtgtgggagccaacatttccagatggactcttcatgtgttggggtcagaaaggaaagaggaccagcctgggcattggaggatctgggtagccctgggctccgctactggccagctgaatggcctggggcaaaggaccactgcctctgtttcttcacctgcaataagaggagtgaggaacgccctctgaagtcccttccaccccagtgagccagcactcttggcctcagcgtcccttcccctcctgtaagctctgcctctggagcttacattgcctagtgtgcacttgggagagtgagcaaagtatctgggtatattttctcttttcatctattctgcagacaagccaaaaaa

SEQ ID NO: 277041 - DNA, 2408 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277042 - DNA, 468 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtaagcactgaggacgcattccctcgcttcagtgtatgcgaaacgccccgtctagtgatcagctcttctctcaggccttggctctcgagaatccggcacggccttggcaaac

SEQ ID NO: 277043 - DNA, 461 bp, Homo sapiens
cggtgatctagccgatccttaactgggtcgagtcctgacgggaaatggcatttcctctggtgccagaggacagggcctgacagcctactcacccacttcgtcactgctcccggctttcccttcgttatgtctcctgggacttcccatggctggaccccgtcctgggcaattctgagacccagagataagtcagatccagacccacctaagccctgacccttactcactttttgagaaactgatagatgaggtcgaaaacgctaggaagtgttggaactttttgcacccagacagtctgattccagatccccaacgcttcctgggagagcagacatttgagctgggactcccaggatatgaaaggacaagaaggtatttcagggacagcagaacaaccttcaaggcacacggagaagttggatgcctctgtaggggggttctttagtggggaatgagacctc

SEQ ID NO: 277044 - DNA, 519 bp, Homo sapiens
tgccaggttgaggaatagggcccttaccctgcaggtcgaggggtgcctaggaaggttctggaaaggtacatgtccactgggcccccttcccatcttactcatttgtgcttccaaggaatgtgaggccaggggcagaggggtggcttgtggcggggccctcaggagatgcctgtgccgaaggaacatcctgggttgtggttgataaggctgactctggcttcccacgcgcttcccccaacacagtgccgtctccctaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccaggtgagctctctcccagtgctgggccttaaaccgggcccagtcccaccatggctg

SEQ ID NO: 277045 - DNA, 2980 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgcaaaaaaaaaaaaaaaaaacaaaaaaaaaaaaaaacaaaagagggggcgcgcgccgctctctctgaagattattcccctcgcggaggggccccagagtttagacgcgcgtaccccggttttctctggctaccaaggtgggccccctaatgagggggaggcgcgttatttataaagctctaaggcatgtggggccgttcctgtttacaaccaagcgttccgagtgaaccgtgggaaccaaacgtgctctcacccgtgggggcatccttcggcgggaagaggaaaacccccttaatcttccgagggggggtgggagcacccataatgtggggcacacaacatcttacccttaccaggagaattttaaagggcccctcatagagggtaaacttattaacacattcttcaagacggggtctattactgtcgtgcttcaacaaccctagcccgtggacatatatttgccgtgcgccgagccatatgagagaatttgggccttctaccgcgagattatgtgaatttaatgcgaaacactttttttactaccccggggaccaatggtatgcaataaacaca

SEQ ID NO: 277046 - DNA, 2080 bp, Homo sapiens
cagccctcgctggttccccccaactcaggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277047 - DNA, 2104 bp, Homo sapiens
  misc_feature (26)..(26): n is a, c, g, or t
tactactactaaattcgcggccgcgncgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277048 - DNA, 1997 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgggccagccagtttgggcgagaggcctgaaggggtgggctcacctgccctgggaggttgggcggagagggacagaccctggtgggacctcaggcccaggctgggctatgacctccctc

SEQ ID NO: 277049 - DNA, 2035 bp, Homo sapiens
tgctgggattacaggcgtgagccaccgcacccggcctgctgtaccttctttgtgcctcagtttccctctttattcaatggggctatcttccagggtagcctcgaggctaagatctgaatccatggccccttactgtctgctcctttcctctcctaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277050 - DNA, 2450 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtaggctgaggtggcggcccttgagaagcacgtgtgggccaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277051 - DNA, 2001 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277052 - DNA, 1962 bp, Homo sapiens
gagtattgatttcaggcaggacccaggtcccaaaatgttagaaacagttatcctttttccctctgagttcgttattctctggggccccagtatccgtggcttaacaacccggctggatagaaggcacctctttccccacgttccaacgagatcccagagctgcttctcattggctcgtccctgagtcagtcacactggaccggaaggtgaaaggccctcattggccagccccgagtcatgtgcccacccctgggatccagctgtgggcctcctttaacagcattccctgaaatgaggggttgcccaggggtggttgggacgctgcagctggaaccgatgtcggccgagcacagacagcctgggacactgggcccctacctgtgcatcacctgtgcgtcacctcccgcctcccagctctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277053 - DNA, 2052 bp, Homo sapiens
gagtattgatttcaggcaggacccaggtcccaaaatgttagaaacagttatcctttttccctctgagttcgttattctctggggccccagtatccgtggcttaacaacccggctggatagaaggcacctctttccccacgttccaacgagatcccagagctgcttctcattggctcgtccctgagtcagtcacactggaccggaaggtgaaaggccctcattggccagccccgagtcatgtgcccacccctgggatccagctgtgggcctcctttaacagcattccctgaaatgaggggttgcccaggggtggttgggacgctgcagctggaaccgatgtcggccgagcacagacagcctgggacactgggcccctacctgtgcatcacctgtgcgtcacctcccgcctcccagctctccccgcaggactcccgcctctaccttgtcttcccccacgactcctctgctctctccaactccttccaccacctgcagctctttgaccaggacagctccaatgtggtgtcagtgagtgtcccccagcaggaggcctggcggttgtgggcagggagggacgagaaggggcgggtcgtgacctccctttgccctcgtccccagcgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277054 - DNA, 2016 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagagctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277055 - DNA, 1017 bp, Homo sapiens
accctcccaaagtgctggggttacaggcgtgcgccatcgcacccggccttcagcttaaatttttgctaacagcgtatctaggagtgtcagttcccttagcgctcaccagcagcgggcagaggtctgtttcgtcgggcgtgctgggcgtcctgcctcccttccatgtccatggcagatgtggaagtataatagcacacttcctctggagagtgggaggaaggaggggcagggcccgcgttcagggctgctcctgcctcacctccgaggttccccagccaggcataagtcacttgcctagacttggggaaggtcttccagtcaggatgacttctcaaactctcagtcccagcgctgggcaaggctgagtgggctccatgtcatcccccagattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277056 - DNA, 1254 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggtaggctccacccgctttgcccttctccactcgctttttttctaggtccgtgctgttgtaagtcatttgagggacctgcgtacaatcccagacctactcgtggggcatgtgtgaccctgtttaggcttgggtactctgcctctccttttgctcctctctgtgaaatgggcagaggatgcccattcaaggaaaaagagcagggagcataagacgcacggtcgtggggacggctgacccctctctccctttgcttcttgggagatccctgccagggtgcaagatgtggattcgagttgcttgaagggaaatggcatttcctctggtgccagaggacagggcctgacagcctactcacccacttcgtcactgctcccggctttcccttcgttatgtctcctgggacttcccatggctggaccccgtcctgggcaattctgagacccagagataagtcagatccagacccacctaagccctgacccttactcactttttgagaaactgatagatgaggtcgaaaacgctaggaagtgttggaactttttgcacccagacagtctgattccagatccccaacgcttcctgggagagcagacatttgagctgggactcccaggatatgaaaggacaagaaggtatttcagggacagcagaacaaccttcaaggcacacggagaagttggatgcctctgtaggggggttctttagtggggaatgagacctc

SEQ ID NO: 277057 - DNA, 480 bp, Homo sapiens
gtatttttttagtagaaacgaggtttctccatattggtcaggctggtctcgaactcccgacctcaggtgatccgcccgcctcagcctcccaaagtgctgggattacaggcgtgagccaccgcacccggcctgctgtaccttctttgtgcctcagtttccctctttattcaatggggctatcttccagggtagcctcgaggctaagatctgaatccatggccccttactgtctgctcctttcctctcctaaggactccagtgggggtgactcatgtgcttctgaggaggaaccaacctttgaccccggctatgaacctgactgggctgtcatcagcactgtgcggccacagccctgccactcagagcccacgagaggtaggctgaggtggcggcccttgagaagcacgtgtgggccaggtaggacacatcttgccctcagtggtcacggtcccaagggctttgctgcccacaatcaagaag

SEQ ID NO: 277058 - DNA, 1121 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaagattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacgaagcacagagtgggcgctcgggcggaggtggttgagtgccgactggcgcctgacccaccccctcccgcagcacatcaacgagctgactatgaagctgagcgtggaggacgtgctgacccgcgccgaggccctgcaccgccagctaaccgcctgccccgagctgcccacaacgtgcaggagatccttggggggcctggcccccgccgcggcaagaggcgccaatatgccccgtccgccaaaccggacttcggtcgcacaaccacagtctgccgggcctacccacatacggccggcctcaacactaacgcgaaccatcagcaggaccattcaaccataacaacgcacaaagaacagagaaaacatcagcatgac

SEQ ID NO: 277059 - DNA, 2482 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacgaagcacagagtgggcgctcgggcggaggtggttgagtgccgactggcgcctgacccaccccctcccgcagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277060 - DNA, 3226 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacgaagcacagagtgggcgctcgggcggaggtggttgagtgccgactggcgcctgacccaccccctcccgcagcacatcaacgagctgactatgaagctgagcgtggaggacgtgctgacccgcgccgacgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgcaaaaaaaaaaaaaaaaaacaaaaaaaaagggggggccacaaaaaaaacccagagaggacccaaagaagagcaggcaaacgccaggaccacacggtgcaacaaggggagcccacacaaggaggagcacccacaaataatatagccagaggagcgaagggaacagagcaaaaacacacacccgaacacacaggacaaaacacggcaacgacagaaagaatcaagtcgaagagagaaaccaccaaaaaaagcagagcagcgagaacacaaaaagagcacacaaaagaacacacacgacccacgcaaaaatcacacacaggaccaaaaggcaacaacacaaaaaagaacctgcaaaaaaggcgagaacaaaacgcacgcaacaacacacaacccaagcccaactacagagccagcaccaaaaaaacgaccacagcgcggcacacacgaggaagtaacgcacacaaaaaagcaacaagatcgcacaacacacccacggggaaacaccgcagggaaaaacaacaagagcgagcaaaaaagcaagaaaccaacaagccagcaaaagcgcgaacgacaaagaaacgacacccgagaaccgacgagacgaacaagagcccgacgaaccacacgacgagaaaagcgaacgaggacgggagaagcgagaggagaggagacacgaaggcagggagggcgagacaagatgggaagcgaaaggagcacgggaggagagaacgaagaaccagacacggagcaggaggagaagacgaagagggaagggcaaggagagagggaaaggagggaagcgggagggaaggacacagcaggcagcagaggaaggccaggggagaagacgcgacgagacagcacagcacgaacgcaggcaaacggaagaaagaaaga

SEQ ID NO: 277061 - DNA, 2664 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaaggcactttagcccgagccaggcacacctgcgagggggcaggtgtgctccgccgccctgctgataagctggcttcattaaactgacacttctcatgtgcaaaaaaaaaaaaaaaaaacaaaaaaaaaaaaaaacaaaagagggggcgcgcgccgctctctctgaagattattcccctcgcggaggggccccagagtttagacgcgcgtaccccggttttctctggctaccaaggtgggccccctaatgagggggaggcgcgttatttataaagctctaaggcatgtggggccgttcctgtttacaaccaagcgttccgagtgaaccgtgggaaccaaacgtgctctcacccgtgggggcatccttcggcgggaagaggaaaacccccttaatcttccgagggggggtgggagcacccataatgtggggcacacaacatcttacccttaccaggagaattttaaagggcccctcatagagggtaaacttattaacacattcttcaagacggggtctattactgtcgtgcttcaacaaccctagcccgtggacatatatttgccgtgcgccgagccatatgagagaatttgggccttctaccgcgagattatgtgaatttaatgcgaaacactttttttactaccccggggaccaatggtatgcaataaacaca

SEQ ID NO: 277062 - DNA, 2106 bp, Homo sapiens
tctgttactgcccggggttatgggatcggcggcgactatgaaggagcgtctcaggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277063 - DNA, 2461 bp, Homo sapiens
gagaagtaagtgggcgtttcaaggcgtgcttgccccaggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaagccaaacacagccaaggcaccaggaagttgcgttacatcacttccgctttccaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgca

SEQ ID NO: 277064 - DNA, 802 bp, Homo sapiens
agggaaggtacatagccacacaagagattccccatcacccaaataccttccactaggtccaactccaacatggcggtcacatttcaacacgaaatttggagggaaaaaacatccaaacaatatcaccatcttacaggctggtgttgtctggtgggctgtttgggaaatactggtctagacacatttctcaaacttggcaatatgactccactggacattaaaaagggatttccaggtatttcaagataaagggatttattctcaggagctgcaaacataagctaggttttcttacagtgttaacatcttggtttcagttacacgggtcaccagattgatacagatttagctgaggtaataaatcactgcttcagcaatcttaacagtcaagtcagttatctaacgatgatttgacaagtaatgaggtcacctgccatttcctcccataagtaattcaactgcatttagttcataatacatatggctagaaaagcatctaaatcaattcctacgatcagagagagagatgtccccatcaccatgaagcagaagttacaaagaaatgggggaagatgctatgcagttggccttaaacatagagaaagggactataagccaaggaatgcaggtggcatctagaggctgaaaagggcaaggaaatggattctcccctcgatcctccagaaggaacacagcccacactttgattttagatttctgacctccaggtctataagatgatcaattcatctctcgatatggcctcctcctgttcattgccactgctctccagtttagactc

SEQ ID NO: 277065 - DNA, 1628 bp, Homo sapiens
gaattttctttattaatgaccccaaccgtatttctttagatacaggagttttgaactcaaatacttaggagaaaacaagttatgactgcattatcctgcaactcattaccagtaatatattgcaaagcgaaacagcttggaaaagagggtgggagaaaagggaagtgagggagggaagataaagaaaaggaattaagttgatcaagtggaattctttttttttttttttttaattcttgggaactatattgtctgaaaaattgtctcaatttttcaagccttttgttagcattaatgcttggttttccatagtaatgatgggttcgttcctctgcatatcttctcttttatagacagatgcattccagaagcccgttccattggaacagcaccctgactatgcggaatacatcttccatccaatggacctttgtacattggaaaaggttggcctccgtcaaagaacctcaccattctagcccacagttgagatgcctaaggctcttccctcactgcctatgctctatcacaagttggacataacaatcttaaattgtttctctatattttcattgctcctttatttggatagaagaactcttgattctctaacgtctttcctttgtaacattcttccaagattgcagtggaatgttgaaattctttggtaatacttttgcgatgattctagctttttacctgcaaaagccatagcttctaagagttagtgatttgattgacttgagcgttacctcctctttctttcggaggtgctaatgagagcagcaggaaggaagaagagaaaattaagtgtctgggaagcctccagattagcaataaagatgtggcttcttagaatttgacttactctactgattaggttttttcttgaatgcctgaaggttttaaaagttcatgctaaaattccacgctgaaaattacacttggaacactgtagattgtgcacattattctgatgctgattttccaactatttgcagcaaaatatgggcagtgaaatgcatccacgaggaagaaacattacttcatattgtcttccccaataactcccaaaccataaatccagtctgtttttaggaaattgcacataccttcatggtgtggtggaaaaaaggaggcattcaaaagagatggagttggaaacctgactttatattaattaagttaagagctgtggaactttagatacattccttaacattactgtatctcagtttgcctttctgtaaaatgggtatgataataagtacttcattaaattattgtgaggtttgtgtgagaccatatgactaataataaataatgtataaatatatgaaataccctgtttggccgggcgcggtggctcaagcctgtaatcccagcagtttgggaggctgaggcgggcggatcatctgaggtcaggagttcgagaccagcctgaccaacatggagaaaccccgtctctactaaaaatacaaaatgagctgggcatggtagcacacgcctgtaattccagctattcaggaggctgaggcaggggaattgcttgaacccgggaggtggaggttgcagtgagccgagatcacgccattgcactccaacctgggcaataagagcaaaactcc

SEQ ID NO: 277066 - DNA, 4436 bp, Homo sapiens
  misc_feature (1357)..(1357): n is a, c, g, or t
  misc_feature (2241)..(2241): n is a, c, g, or t
agcaatgcacacgagcagacagagaagcaacatctttaaggtactgagggcaggagaagttaatgtagaatactatgccagaaaaaataaattcccaaaagtggaagtgaaataaggacatttagagatgtacaaaagctgaccgaattcactaccagtcaacccacactacaagaaacatcaaatgagtcctccaagcagaaggaatccaataccagatgaaaatccagatctccacgaggaaatgaagaacaccagaaatggatcggccctttcttcaaataagagcagttggaataacaaagctgttcagttgtacccttggaatccactgaaatcctgggtagggaagctccagtaccaccaactggaaagactgggaatgcctaatagctggtactggccattgtcgtaggctttgtccactctgacaaactgaagatggggactcgactcaccttcgccagccacaggaggacctccagacgaggttaggtcgacttcccgataactttagatcctgaaacctcacgggatttttcttctcttccctttgatctctcttccgcttgctcaacaggacaggactcgctgcctttctttcccgtcagaaagggatcccttgcggacaggacctaagtgagtagctggtttcccctacttgtccttccgggcctgggtgtctcgggggctcaggctgacgggagacctaactaccggcgagtgagaccagcaggagcctggaggggcgcgcaccagggtggaggtttggtgccgggggttgagaacaacagtcaaaccctcttcttcccctggcaccacgcacctgccccccgggatgccgaacgaagtggtccctaaagctcctctgcaggcccaaccgaaacaggcctgaagctccaggatgggcgagaggatcctctttgagcgaaaccagccttctgcctggctggccctggtcaacaccctgggaagaggccgatttggcggacagaacggaagaaaagacctaaaggtagaatctcatgatgtcgagatgttaaaacactcaaattttaaggttcgactgtgagggggagatagggggtctcgagctggatcgacccctgagccttcatctgcagagtcctgtgcaccagctcagaggacaggactatgtgcaccaatggttctcatcaggcggcaacttcaccctcacatgcctcccccatccctgctggtacacaagaccacgactaggggaagcccggagggagaatgttaacccctggcatctatctagtcagcagaggtgagggatgctgctaaacaccttacaatccaccggaggacacccgcccccaccgaccccgaagtngccattccctggaggtggggaaactcgcctgtagatcaatgcccacgcacttggcggacaggaaatcacgaattggccactaactggatcttggatctgaggaaaaaattccagcgtcagagggaactctcggagatttgcccagagcataaggaacgtactccttccctcagtgatggatcctcacatctgggggaaatcatagacaatttcttttgtagggcgaactctgctatacagtttatgatgtcagagtgaatactttctttgagttgcagtcagaaactgtagatttttaaaaatttaaaattcattattctctgtcagtattccaaagtgtatacagaaagctattgcactgttcaggagatggcgcttaacattttggaaattcaaggtgatgaatgtccagataagactatctctcctggtacaaagtttgacaatgctgaacatttttaaaggttctttttgatatacaaagtgcaccaatgagtgctttttaattcttacaataattctgggtgaggtaggtatttttccaattcccattttatgcttcggtagccctttgtatttatacttcaaaacacttggctctcttgtaattatttaagaaattagttgtgattatttgtttaatgtgcaggagttacaaaaggcaagctttagaacaagacagacctggttatgattcctggctctgaaagctgtacaccctgtgaccctagacaggtgttttaatgcctcgctgcctctgtttcttgctctgtaaaatgtgaacaataacagtattggcctcatgctttttttgggttttaaaagtaataatgtggacaaagatcagtggagtgcctggcatgctgaacccattccatgactgntagatatagttgttatgatttgtatcaatccattttcacactgctataaggaactacctgagactgggtaatctatgaagaaaagaggtttaattgactcacagttctgcatggctgggagtcctcaggaacttacaatcatggcagaaggggaagcaagacatttcttatatggcagcaggacagaaagagagagagtgaagggggaagtgccacacacttccaaacaaccatatcttgtggttaattaaaaagtactcattggtgtgccttgtatagaaaaaaatatacactcactatcatgagaacagcaaggagggagtctgcccccaagattcaatcacctcccagtagacccctcccctgacatgtggggattacaattcaagatgagatttgggtggggaaacagagtcaaaccatatcgtgattgttctataataaagagatgcccacatgtgtttcatcagggacagtgctcattaaccagttgtcctgccgtaattattaatagtatcccctttgctttcaaaagtgtcctagtttacaaaaagtatagaaatggaggacagaatagtggttgcccaagattggaaaagggtaagggtaaagggtgcagaggtggatgtggttataaaaggcaacatgggagatcctcgtagtgaaggaactgtttagtatctccactgtggtggtagatacccgaacctaaacatgtgaaaaattgcatgaaactaaacacacacacaaacaagtacaagttaagttaggaaaatccaaataagatttctacattgtatcaataggtatatcttgattatgatattgcaagatggtactattcaaggaaactgggtagaggctacatgagactcccctgtattatttcctataactccatgtgaatctacaaggatctcaggattaaggaagatatcctagtttggaagataaaaaatatatcccagtagtaatatccactgtcccaccagggcctgactaccttctataaaaagaagtgcctttgttcccctcaagttcctttatttggttttattcttcttcacagtacctacctccacttggcagattacatttattttttcatctttcaacagctatttactgaatgcctactagatgccaggcttgagatctagcaatgaacaagatctctgtgaaacttacattccaggaggagaaataaataataaaccaaaaatataatcagtaaattatttaatatgctgggaaacaatatgtgtaatggaagaaatatgtaaagtgatggattagggttctccagagaaacagaaccaacaattgactcatgtgattatggaggctgagaagtctcaagatcacagttggcaagcttgagacacaggagagcccatggtgtgtttctgatttgagtccaaaggcctgagaaccaggagagatgatggtgtgattacagttcaaaagctggcaggcttgaggcccaggaagagccagtgttgcagttcaattccaaaggcaggaaaaggctgatatctcagctgaagcaatcaggcagaaggagctctctcttactcatgggcaggtcagacttttggttctattcaggcctttaagtgattggatgaggatcatctactggggaaagaaataagctttattcagtgtactgattcaaatgttaatctcatccaaaaccatgctcacagacacacccagcataatgtttgaccaagtatctgggcaccttgtggttcagtcaaattaacacatattaactaccttagcaagatgaaaagcagtgaatgcaggatggtggttgaaattttaaatacgttggttatatagtctcattgaaaaaggaacatttgagtgaagacttgaaggggtggtggaataaaccatttatttgcttattgcctgtctccctctatcagaatgaaagcttcatgaagcgagagacttaatttttatctgttatatccctagtgcctggtgcagggtaagtactcaaaaatatttgttgagtgaataagtaatgattgaggatggggactggtttgtatctggttatatctcttgtccttagcacagtacctggcacatcctaagccatccaaaagagttggttatatgattgtctttgaattctatgactgtttataatatacagtaaacttcactgaagacactga

SEQ ID NO: 277067 - DNA, 4170 bp, Homo sapiens
  misc_feature (1091)..(1091): n is a, c, g, or t
  misc_feature (1975)..(1975): n is a, c, g, or t
agcaatgcacacgagcagacagagaagcaacatctttaaggtactgagggcaggagaagttaatgtagaatactatgccagaaaaaataaattcccaaaagtggaagtgaaataaggacatttagagatgtacaaaagctgaccgaattcactaccagtcaacccacactacaagaaacatcaaatgagtcctccaagcagaaggaatccaataccagatgaaaatccagatctccacgaggaaatgaagaacaccagaaatggatcggccctttcttcaaataagagcagttggaataacaaagctgttcagttgtacccttggaatccactgaaatcctgggtagggaagctccagtaccaccaactggaaagactgggaatgcctaatagctggtactggccattgtcgtaggctttgtccactctgacaaactgaagatggggactcgactcaccttcgccagccacaggaggacctccagacgaggacaggactcgctgcctttctttcccgtcagaaagggatcccttgcggacaggacctaagcaccacgcacctgccccccgggatgccgaacgaagtggtccctaaagctcctctgcaggcccaaccgaaacaggcctgaagctccaggatgggcgagaggatcctctttgagcgaaaccagccttctgcctggctggccctggtcaacaccctgggaagaggccgatttggcggacagaacggaagaaaagacctaaaggtagaatctcatgatgtcgagatgttaaaacactcaaattttaaggttcgactgtgagggggagatagggggtctcgagctggatcgacccctgagccttcatctgcagagtcctgtgcaccagctcagaggacaggactatgtgcaccaatggttctcatcaggcggcaacttcaccctcacatgcctcccccatccctgctggtacacaagaccacgactaggggaagcccggagggagaatgttaacccctggcatctatctagtcagcagaggtgagggatgctgctaaacaccttacaatccaccggaggacacccgcccccaccgaccccgaagtngccattccctggaggtggggaaactcgcctgtagatcaatgcccacgcacttggcggacaggaaatcacgaattggccactaactggatcttggatctgaggaaaaaattccagcgtcagagggaactctcggagatttgcccagagcataaggaacgtactccttccctcagtgatggatcctcacatctgggggaaatcatagacaatttcttttgtagggcgaactctgctatacagtttatgatgtcagagtgaatactttctttgagttgcagtcagaaactgtagatttttaaaaatttaaaattcattattctctgtcagtattccaaagtgtatacagaaagctattgcactgttcaggagatggcgcttaacattttggaaattcaaggtgatgaatgtccagataagactatctctcctggtacaaagtttgacaatgctgaacatttttaaaggttctttttgatatacaaagtgcaccaatgagtgctttttaattcttacaataattctgggtgaggtaggtatttttccaattcccattttatgcttcggtagccctttgtatttatacttcaaaacacttggctctcttgtaattatttaagaaattagttgtgattatttgtttaatgtgcaggagttacaaaaggcaagctttagaacaagacagacctggttatgattcctggctctgaaagctgtacaccctgtgaccctagacaggtgttttaatgcctcgctgcctctgtttcttgctctgtaaaatgtgaacaataacagtattggcctcatgctttttttgggttttaaaagtaataatgtggacaaagatcagtggagtgcctggcatgctgaacccattccatgactgntagatatagttgttatgatttgtatcaatccattttcacactgctataaggaactacctgagactgggtaatctatgaagaaaagaggtttaattgactcacagttctgcatggctgggagtcctcaggaacttacaatcatggcagaaggggaagcaagacatttcttatatggcagcaggacagaaagagagagagtgaagggggaagtgccacacacttccaaacaaccatatcttgtggttaattaaaaagtactcattggtgtgccttgtatagaaaaaaatatacactcactatcatgagaacagcaaggagggagtctgcccccaagattcaatcacctcccagtagacccctcccctgacatgtggggattacaattcaagatgagatttgggtggggaaacagagtcaaaccatatcgtgattgttctataataaagagatgcccacatgtgtttcatcagggacagtgctcattaaccagttgtcctgccgtaattattaatagtatcccctttgctttcaaaagtgtcctagtttacaaaaagtatagaaatggaggacagaatagtggttgcccaagattggaaaagggtaagggtaaagggtgcagaggtggatgtggttataaaaggcaacatgggagatcctcgtagtgaaggaactgtttagtatctccactgtggtggtagatacccgaacctaaacatgtgaaaaattgcatgaaactaaacacacacacaaacaagtacaagttaagttaggaaaatccaaataagatttctacattgtatcaataggtatatcttgattatgatattgcaagatggtactattcaaggaaactgggtagaggctacatgagactcccctgtattatttcctataactccatgtgaatctacaaggatctcaggattaaggaagatatcctagtttggaagataaaaaatatatcccagtagtaatatccactgtcccaccagggcctgactaccttctataaaaagaagtgcctttgttcccctcaagttcctttatttggttttattcttcttcacagtacctacctccacttggcagattacatttattttttcatctttcaacagctatttactgaatgcctactagatgccaggcttgagatctagcaatgaacaagatctctgtgaaacttacattccaggaggagaaataaataataaaccaaaaatataatcagtaaattatttaatatgctgggaaacaatatgtgtaatggaagaaatatgtaaagtgatggattagggttctccagagaaacagaaccaacaattgactcatgtgattatggaggctgagaagtctcaagatcacagttggcaagcttgagacacaggagagcccatggtgtgtttctgatttgagtccaaaggcctgagaaccaggagagatgatggtgtgattacagttcaaaagctggcaggcttgaggcccaggaagagccagtgttgcagttcaattccaaaggcaggaaaaggctgatatctcagctgaagcaatcaggcagaaggagctctctcttactcatgggcaggtcagacttttggttctattcaggcctttaagtgattggatgaggatcatctactggggaaagaaataagctttattcagtgtactgattcaaatgttaatctcatccaaaaccatgctcacagacacacccagcataatgtttgaccaagtatctgggcaccttgtggttcagtcaaattaacacatattaactaccttagcaagatgaaaagcagtgaatgcaggatggtggttgaaattttaaatacgttggttatatagtctcattgaaaaaggaacatttgagtgaagacttgaaggggtggtggaataaaccatttatttgcttattgcctgtctccctctatcagaatgaaagcttcatgaagcgagagacttaatttttatctgttatatccctagtgcctggtgcagggtaagtactcaaaaatatttgttgagtgaataagtaatgattgaggatggggactggtttgtatctggttatatctcttgtccttagcacagtacctggcacatcctaagccatccaaaagagttggttatatgattgtctttgaattctatgactgtttataatatacagtaaacttcactgaagacactga

SEQ ID NO: 277068 - DNA, 4121 bp, Homo sapiens
  misc_feature (1357)..(1357): n is a, c, g, or t
  misc_feature (2241)..(2241): n is a, c, g, or t
agcaatgcacacgagcagacagagaagcaacatctttaaggtactgagggcaggagaagttaatgtagaatactatgccagaaaaaataaattcccaaaagtggaagtgaaataaggacatttagagatgtacaaaagctgaccgaattcactaccagtcaacccacactacaagaaacatcaaatgagtcctccaagcagaaggaatccaataccagatgaaaatccagatctccacgaggaaatgaagaacaccagaaatggatcggccctttcttcaaataagagcagttggaataacaaagctgttcagttgtacccttggaatccactgaaatcctgggtagggaagctccagtaccaccaactggaaagactgggaatgcctaatagctggtactggccattgtcgtaggctttgtccactctgacaaactgaagatggggactcgactcaccttcgccagccacaggaggacctccagacgaggttaggtcgacttcccgataactttagatcctgaaacctcacgggatttttcttctcttccctttgatctctcttccgcttgctcaacaggacaggactcgctgcctttctttcccgtcagaaagggatcccttgcggacaggacctaagtgagtagctggtttcccctacttgtccttccgggcctgggtgtctcgggggctcaggctgacgggagacctaactaccggcgagtgagaccagcaggagcctggaggggcgcgcaccagggtggaggtttggtgccgggggttgagaacaacagtcaaaccctcttcttcccctggcaccacgcacctgccccccgggatgccgaacgaagtggtccctaaagctcctctgcaggcccaaccgaaacaggcctgaagctccaggatgggcgagaggatcctctttgagcgaaaccagccttctgcctggctggccctggtcaacaccctgggaagaggccgatttggcggacagaacggaagaaaagacctaaaggtagaatctcatgatgtcgagatgttaaaacactcaaattttaaggttcgactgtgagggggagatagggggtctcgagctggatcgacccctgagccttcatctgcagagtcctgtgcaccagctcagaggacaggactatgtgcaccaatggttctcatcaggcggcaacttcaccctcacatgcctcccccatccctgctggtacacaagaccacgactaggggaagcccggagggagaatgttaacccctggcatctatctagtcagcagaggtgagggatgctgctaaacaccttacaatccaccggaggacacccgcccccaccgaccccgaagtngccattccctggaggtggggaaactcgcctgtagatcaatgcccacgcacttggcggacaggaaatcacgaattggccactaactggatcttggatctgaggaaaaaattccagcgtcagagggaactctcggagatttgcccagagcataaggaacgtactccttccctcagtgatggatcctcacatctgggggaaatcatagacaatttcttttgtagggcgaactctgctatacagtttatgatgtcagagtgaatactttctttgagttgcagtcagaaactgtagatttttaaaaatttaaaattcattattctctgtcagtattccaaagtgtatacagaaagctattgcactgttcaggagatggcgcttaacattttggaaattcaaggtgatgaatgtccagataagactatctctcctggtacaaagtttgacaatgctgaacatttttaaaggttctttttgatatacaaagtgcaccaatgagtgctttttaattcttacaataattctgggtgaggtaggtatttttccaattcccattttatgcttcggtagccctttgtatttatacttcaaaacacttggctctcttgtaattatttaagaaattagttgtgattatttgtttaatgtgcaggagttacaaaaggcaagctttagaacaagacagacctggttatgattcctggctctgaaagctgtacaccctgtgaccctagacaggtgttttaatgcctcgctgcctctgtttcttgctctgtaaaatgtgaacaataacagtattggcctcatgctttttttgggttttaaaagtaataatgtggacaaagatcagtggagtgcctggcatgctgaacccattccatgactgntagatatagttgttatgatttgtatcaatccattttcacactgctataaggaactacctgagactgggtaatctatgaagaaaagaggtttaattgactcacagttctgcatggctgggagtcctcaggaacttacaatcatggcagaaggggaagcaagacatttcttatatggcagcaggacagaaagagagagagtgaagggggaagtgccacacacttccaaacaaccatatcttgtggttaattaaaaagtactcattggtgtgccttgtatagaaaaaaatatacactcactatcatgagaacagcaaggagggagtctgcccccaagattcaatcacctcccagtagacccctcccctgacatgtggggattacaattcaagatgagatttgggtggggaaacagagtcaaaccatatcgtgattgttctataataaagagatgcccacatgtgtttcatcagggacagtgctcattaaccagttgtcctgccgtaattattaatagtatcccctttgctttcaaaagtgtcctagtttacaaaaagtatagaaatggaggacagaatagtggttgcccaagattggaaaagggtaagggtaaagggtgcagaggtggatgtggttataaaaggcaacatgggagatcctcgtagtgaaggaactgtttagtatctccactgtggtggtagatacccgaacctaaacatgtgaaaaattgcatgaaactaaacacacacacaaacaagtacaagttaagttaggaaaatccaaataagatttctacattgtatcaataggtatatcttgattatgatattgcaagatggtactattcaaggaaactgggtagaggctacatgagactcccctgtattatttcctataactccatgtgaatctacaaggatctcaggattaaggaagatatcctagtttggaagataaaaaatatatcccagtagtaatatccactgtcccaccagggcctgactaccttctataaaaagaagtgcctttgttcccctcaagttcctttatttggttttattcttcttcacagtacctacctccacttggcagattacatttattttttcatctttcaacagctatttactgaatgcctactagatgccaggcttgagatctagcaatgaacaagatctctgtgaaacttacattccaggaggagaaataaataataaaccaaaaatataatcagtaaattatttaatatgctgggaaacaatatgtgtaatggaagaaatatgtaaagtgatggattagggttctccagagaaacagaaccaacaattgactcatgtgattatggaggctgagaagtctcaagatcacagttggcaagcttgagacacaggagagcccatggtgtgtttctgatttgagtccaaaggcctgagaaccaggagagatgatggtgtgattacagttcaaaagctggcaggcttgaggcccaggaagagccagtgttgcagttcaattccaaaggcaggaaaaggctgatatctcagctgaagcaatcaggcagaaggagctctctcttactcatgggcaggtcagacttttggttctattcaggcctttaagtgattggatgaggatcatttgttaggagggtctcagtgcagaagccaagccagaggggtgcaggcaaaatacagcactggcaggagagtccctgaaggctgtgacccttctgcagacaacagcatcactatgctaggcacaaatgtgtcagttctttaggtcttttcttccgttctgtcctccaaatcggcctcttccgagtgtgttgaccagggccagccaggcagaaggctggtttcgctcaaagaggatcctctcgccca

SEQ ID NO: 277069 - DNA, 4266 bp, Homo sapiens
  misc_feature (1187)..(1187): n is a, c, g, or t
  misc_feature (2071)..(2071): n is a, c, g, or t
gagatacagaatggggaagaacaagttggaaccagaaaactgatttcagggtctggcacttgaatgtctgattttggagaaagagaagacactgatcggccctttcttcaaataagagcagttggaataacaaagctgttcagttgtacccttggaatccactgaaatcctgggtagggaagctccagtaccaccaactggaaagactgggaatgcctaatagctggtactggccattgtcgtaggctttgtccactctgacaaactgaagatggggactcgactcaccttcgccagccacaggaggacctccagacgaggttaggtcgacttcccgataactttagatcctgaaacctcacgggatttttcttctcttccctttgatctctcttccgcttgctcaacaggacaggactcgctgcctttctttcccgtcagaaagggatcccttgcggacaggacctaagtgagtagctggtttcccctacttgtccttccgggcctgggtgtctcgggggctcaggctgacgggagacctaactaccggcgagtgagaccagcaggagcctggaggggcgcgcaccagggtggaggtttggtgccgggggttgagaacaacagtcaaaccctcttcttcccctggcaccacgcacctgccccccgggatgccgaacgaagtggtccctaaagctcctctgcaggcccaaccgaaacaggcctgaagctccaggatgggcgagaggatcctctttgagcgaaaccagccttctgcctggctggccctggtcaacaccctgggaagaggccgatttggcggacagaacggaagaaaagacctaaaggtagaatctcatgatgtcgagatgttaaaacactcaaattttaaggttcgactgtgagggggagatagggggtctcgagctggatcgacccctgagccttcatctgcagagtcctgtgcaccagctcagaggacaggactatgtgcaccaatggttctcatcaggcggcaacttcaccctcacatgcctcccccatccctgctggtacacaagaccacgactaggggaagcccggagggagaatgttaacccctggcatctatctagtcagcagaggtgagggatgctgctaaacaccttacaatccaccggaggacacccgcccccaccgaccccgaagtngccattccctggaggtggggaaactcgcctgtagatcaatgcccacgcacttggcggacaggaaatcacgaattggccactaactggatcttggatctgaggaaaaaattccagcgtcagagggaactctcggagatttgcccagagcataaggaacgtactccttccctcagtgatggatcctcacatctgggggaaatcatagacaatttcttttgtagggcgaactctgctatacagtttatgatgtcagagtgaatactttctttgagttgcagtcagaaactgtagatttttaaaaatttaaaattcattattctctgtcagtattccaaagtgtatacagaaagctattgcactgttcaggagatggcgcttaacattttggaaattcaaggtgatgaatgtccagataagactatctctcctggtacaaagtttgacaatgctgaacatttttaaaggttctttttgatatacaaagtgcaccaatgagtgctttttaattcttacaataattctgggtgaggtaggtatttttccaattcccattttatgcttcggtagccctttgtatttatacttcaaaacacttggctctcttgtaattatttaagaaattagttgtgattatttgtttaatgtgcaggagttacaaaaggcaagctttagaacaagacagacctggttatgattcctggctctgaaagctgtacaccctgtgaccctagacaggtgttttaatgcctcgctgcctctgtttcttgctctgtaaaatgtgaacaataacagtattggcctcatgctttttttgggttttaaaagtaataatgtggacaaagatcagtggagtgcctggcatgctgaacccattccatgactgntagatatagttgttatgatttgtatcaatccattttcacactgctataaggaactacctgagactgggtaatctatgaagaaaagaggtttaattgactcacagttctgcatggctgggagtcctcaggaacttacaatcatggcagaaggggaagcaagacatttcttatatggcagcaggacagaaagagagagagtgaagggggaagtgccacacacttccaaacaaccatatcttgtggttaattaaaaagtactcattggtgtgccttgtatagaaaaaaatatacactcactatcatgagaacagcaaggagggagtctgcccccaagattcaatcacctcccagtagacccctcccctgacatgtggggattacaattcaagatgagatttgggtggggaaacagagtcaaaccatatcgtgattgttctataataaagagatgcccacatgtgtttcatcagggacagtgctcattaaccagttgtcctgccgtaattattaatagtatcccctttgctttcaaaagtgtcctagtttacaaaaagtatagaaatggaggacagaatagtggttgcccaagattggaaaagggtaagggtaaagggtgcagaggtggatgtggttataaaaggcaacatgggagatcctcgtagtgaaggaactgtttagtatctccactgtggtggtagatacccgaacctaaacatgtgaaaaattgcatgaaactaaacacacacacaaacaagtacaagttaagttaggaaaatccaaataagatttctacattgtatcaataggtatatcttgattatgatattgcaagatggtactattcaaggaaactgggtagaggctacatgagactcccctgtattatttcctataactccatgtgaatctacaaggatctcaggattaaggaagatatcctagtttggaagataaaaaatatatcccagtagtaatatccactgtcccaccagggcctgactaccttctataaaaagaagtgcctttgttcccctcaagttcctttatttggttttattcttcttcacagtacctacctccacttggcagattacatttattttttcatctttcaacagctatttactgaatgcctactagatgccaggcttgagatctagcaatgaacaagatctctgtgaaacttacattccaggaggagaaataaataataaaccaaaaatataatcagtaaattatttaatatgctgggaaacaatatgtgtaatggaagaaatatgtaaagtgatggattagggttctccagagaaacagaaccaacaattgactcatgtgattatggaggctgagaagtctcaagatcacagttggcaagcttgagacacaggagagcccatggtgtgtttctgatttgagtccaaaggcctgagaaccaggagagatgatggtgtgattacagttcaaaagctggcaggcttgaggcccaggaagagccagtgttgcagttcaattccaaaggcaggaaaaggctgatatctcagctgaagcaatcaggcagaaggagctctctcttactcatgggcaggtcagacttttggttctattcaggcctttaagtgattggatgaggatcatctactggggaaagaaataagctttattcagtgtactgattcaaatgttaatctcatccaaaaccatgctcacagacacacccagcataatgtttgaccaagtatctgggcaccttgtggttcagtcaaattaacacatattaactaccttagcaagatgaaaagcagtgaatgcaggatggtggttgaaattttaaatacgttggttatatagtctcattgaaaaaggaacatttgagtgaagacttgaaggggtggtggaataaaccatttatttgcttattgcctgtctccctctatcagaatgaaagcttcatgaagcgagagacttaatttttatctgttatatccctagtgcctggtgcagggtaagtactcaaaaatatttgttgagtgaataagtaatgattgaggatggggactggtttgtatctggttatatctcttgtccttagcacagtacctggcacatcctaagccatccaaaagagttggttatatgattgtctttgaattctatgactgtttataatatacagtaaacttcactgaagacactga

SEQ ID NO: 277070 - DNA, 2472 bp, Homo sapiens
agcgggactcccggcggaagcgcgcggcgcgcggggaggcccgaactgatccgcggcggccggagaccgctggggacagacaggtagcgccgtcacccgcgggatccgcagctccatctgccgggcgaaggggctctggtcgggagagggctcagcgggcggaagcgcgtctctagagaagggtgcggtcgataaccgggggcgcccctggaaggccgaggatgggcagcagctcgctgtccgaggactaccgccagtgcctggagcgcgagctgcgacggggccgcgcgggcgtgtgcggggacccctcgctgcgcgcggtgctctggcagatcctggtggaggacttcgacctgcacggggcgctgcaggacgacgcgctggctctgctcaccgacgggctgtggggccgcgccgacctggcgcccgcgctacgcggcctggctcgcgccttcgagcttctggagctcgccgcggtgcacctgtacctgctgccctggaggaaggagttcaccaccatcaagaccttctctgggggctacgtgcacgtgctgaagggtgtgctctcagacgacctcctcctgaagagcttccagaagatgggctacgtacgcagagacagccatcggctcatggtgaccgccctgccccccgcctgccagctggtgcaggtggccctgggctgcttcgccctccggctggagtgtgagatcctgggtgaggtgctggcccagctgggcaccagtgtgctgccagctgaggagctgctgcaggcacggcgtgccagcggggacgtggcctcctgtgtggcctggctgcagcagcggctggcccaggatgaggagccgccacccctgcccccccgaggctcccctgctgcttacagggccccactggacttataccgggacttgcaggaagacgaggggtcggaggacgccagcctgtatggggagccgtcaccaggccctgactcgcccccggcggagctggcctacaggccaccactctgggagcagagtgccaaactgtggggcactgggggccgggcctgggagcccccagctgaggagctgccgcaggccagcagcccaccatatggggccttggaggaggggctggaacctgaaccttccgccttctccttcctctctctgcgccgtgagctgagtaggcctggggacctggccacccctgaaagctctgcagcggccagcccgaggcgtattcgggcagagggggtaccagcctcagcctataggtctgtctcggagcccccaggctaccaggcacacagctgcctgtcccctggcgccctgcccaccctctgctgcgacacctgtcgccagctgcatgctgcccactgtgcagccctgcccgcctgccgtccaggccactcgctgcgtgtgctgcttggcgacgcccagcggcgcttgtggctacagcgtgcacagatggacactctgctctacaacagccccggggcccggccctaggccagctgggccccaggtcaagggctcttgggagacagctcccgtggtgcttctctttgctggggaggggtctgggcctctggttgccttgtccctgggggagtcctgggcacagcagggggttggagagtccaggccaacccttgctggaggtgggactctctgtatatggaaggctccaagggcagcaggcctaagccggccagcaggagcctttccacatttccccaccctcggaacccagacgcatgcccacatgtgctgggtagaggggtccagcctgttccagccagtgcctgaacctgtccctgagaaggaccctgtgccccaaggcccgtggctcctggcctgctccctgcagtacggagtacggggctcaggacttgggggtcctccacgtgtcccagggattctccacacgagtgtcctcaagggcctgttggtgacaccgagctccccccaccccaagctctgctggagccaatctgcggggctctgccgggtgcacggctgacctggcttcggggacgccggccctccccttgggtgtcacagcagctgggcccacagacaggaaatgacctgacctcaaaccagatgtggaggtgcacgagaggcgcaggaacgggcagtggctgacagctgggaaggccctgagcgtcactgctgctgggcggaagggcctgtggacagcccacccaggcggcggggtcttggtgggtccagtggtaatggtgcccctcccctccattccctgtgggtgcagcccacaggctggcgaggaggtgcctctgccctaccctcgggtctggcgagggagagggcagggtgcatccactgtgacagcccctctgggcccacaactccctgaccctggaagctgagcctgctttcctgaccctccgccccaccccctcctccccagaacactcagagggacggtcaacatcagagcacattaaacgctggtgaaacc

SEQ ID NO: 277071 - DNA, 2335 bp, Homo sapiens
agcgggactcccggcggaagcgcgcggcgcgcggggaggcccgaactgatccgcggcggccggagaccgctggggacagacaggatgggcagcagctcgctgtccgaggactaccgccagtgcctggagcgcgagctgcgacggggccgcgcgggcgtgtgcggggacccctcgctgcgcgcggtgctctggcagatcctggtggaggacttcgacctgcacggggcgctgcaggacgacgcgctggctctgctcaccgacgggctgtggggccgcgccgacctggcgcccgcgctacgcggcctggctcgcgccttcgagcttctggagctcgccgcggtgcacctgtacctgctgccctggaggaaggagttcaccaccatcaagaccttctctgggggctacgtgcacgtgctgaagggtgtgctctcagacgacctcctcctgaagagcttccagaagatgggctacgtacgcagagacagccatcggctcatggtgaccgccctgccccccgcctgccagctggtgcaggtggccctgggctgcttcgccctccggctggagtgtgagatcctgggtgaggtgctggcccagctgggcaccagtgtgctgccagctgaggagctgctgcaggcacggcgtgccagcggggacgtggcctcctgtgtggcctggctgcagcagcggctggcccaggatgaggagccgccacccctgcccccccgaggctcccctgctgcttacagggccccactggacttataccgggacttgcaggaagacgaggggtcggaggacgccagcctgtatggggagccgtcaccaggccctgactcgcccccggcggagctggcctacaggccaccactctgggagcagagtgccaaactgtggggcactgggggccgggcctgggagcccccagctgaggagctgccgcaggccagcagcccaccatatggggccttggaggaggggctggaacctgaaccttccgccttctccttcctctctctgcgccgtgagctgagtaggcctggggacctggccacccctgaaagctctgcagcggccagcccgaggcgtattcgggcagagggggtaccagcctcagcctataggtctgtctcggagcccccaggctaccaggcacacagctgcctgtcccctggcgccctgcccaccctctgctgcgacacctgtcgccagctgcatgctgcccactgtgcagccctgcccgcctgccgtccaggccactcgctgcgtgtgctgcttggcgacgcccagcggcgcttgtggctacagcgtgcacagatggacactctgctctacaacagccccggggcccggccctaggccagctgggccccaggtcaagggctcttgggagacagctcccgtggtgcttctctttgctggggaggggtctgggcctctggttgccttgtccctgggggagtcctgggcacagcagggggttggagagtccaggccaacccttgctggaggtgggactctctgtatatggaaggctccaagggcagcaggcctaagccggccagcaggagcctttccacatttccccaccctcggaacccagacgcatgcccacatgtgctgggtagaggggtccagcctgttccagccagtgcctgaacctgtccctgagaaggaccctgtgccccaaggcccgtggctcctggcctgctccctgcagtacggagtacggggctcaggacttgggggtcctccacgtgtcccagggattctccacacgagtgtcctcaagggcctgttggtgacaccgagctccccccaccccaagctctgctggagccaatctgcggggctctgccgggtgcacggctgacctggcttcggggacgccggccctccccttgggtgtcacagcagctgggcccacagacaggaaatgacctgacctcaaaccagatgtggaggtgcacgagaggcgcaggaacgggcagtggctgacagctgggaaggccctgagcgtcactgctgctgggcggaagggcctgtggacagcccacccaggcggcggggtcttggtgggtccagtggtaatggtgcccctcccctccattccctgtgggtgcagcccacaggctggcgaggaggtgcctctgccctaccctcgggtctggcgagggagagggcagggtgcatccactgtgacagcccctctgggcccacaactccctgaccctggaagctgagcctgctttcctgaccctccgccccaccccctcctccccagaacactcagagggacggtcaacatcagagcacattaaacgctggtgaaacc

SEQ ID NO: 277072 - DNA, 1005 bp, Homo sapiens
agcgggactcccggcggaagcgcgcggcgcgcggggaggcccgaactgatccgcggcggccggagaccgctggggacagacaggatgggcagcagctcgctgtccgaggactaccgccagtgcctggagcgcgagctgcgacggggccgcgcgggcgtgtgcggggacccctcgctgcgcgcggtgctctggcagatcctggtggaggacttcgacctgcacggggcgctgcaggacgacgcgctggctctgctcaccgacgggctgtggggccgcgccgacctggcgcccgcgctacgcggcctggctcgcgccttcgagcttctggagctcgccgcggtgcacctgtacctgctgccctggaggaaggagttcaccaccatcaagaccttctctgggggctacgtgcacgtgctgaagggtgtgctctcagacgacctcctcctgaagagcttccagaagatgggctacgtacgcagagacagccatcggctcatgctctgctggagccaatctgcggggctctgccgggtgcacggctgacctggcttcggggacgccggccctccccttgggtgtcacagcagctgggcccacagacaggaaatgacctgacctcaaaccagatgtggaggtgcacgagaggcgcaggaacgggcagtggctgacagctgggaaggccctgagcgtcactgctgctgggcggaagggcctgtggacagcccacccaggcggcggggtcttggtgggtccagtggtaatggtgcccctcccctccattccctgtgggtgcagcccacaggctggcgaggaggtgcctctgccctaccctcgggtctggcgagggagagggcagggtgcatccactgtgacagcccctctgggcccacaactccctgaccctggaagctgagcctgctttcctgaccctccgccccaccccctcctccccagaacactcagagggacggtcaacatcagagcacattaaacgctggtgaaacc

SEQ ID NO: 277073 - DNA, 3749 bp, Homo sapiens
  misc_feature (3073)..(3073): n is a, c, g, or t
agattgtgggagtggagaagagaatgcctgtgtcctgagataattctgtaagtaaatgccagtccctaggaagagagaaccaaaatgtctaccggaccagatgtcaaggctacagtgggggacatttccagtgatggcaatttaaacgtggctcaagaggaatgctccaggaaagggatagtggatgaattcttcccgctgttgtcaaactaatgtatatggactcaaccacagggatatccccagagctcctatggaacactagcaaattttgtgtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggaatgaaactctaaaagaatttaaagcaatggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggttatggtattaactggtcagtattcaatttgggtcaaatgggctcccccactggaaaggagtcaactcaccaccattgctggatcagggtcaatgctggggtccttcattgttctacttgctggtggtctcctctgccagaccataggatggccttacgtcttctatatctttggaggaattggctgtgcttgttgtcctctctggtttcctctcatttatgatgatcctgtgaatcatccctttatcagtgctggtgagaagagatacattgtgtgttcattggctcagcaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactccaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggccacccctgcaaagtttcagctgagctgggatctgaaggataatagttaactgttgtgggagactgagaggagaatattttaggaagaaagaacagcataagcaaaagtttcatggcaggagggagaaattagctatggccagagtatagagaataagggaagtatgatttgtgaggagnctgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttgatttaggtggattatttgatttagggaataaacctgacgggtcctattactaagtgagagagtgaaagatgtccagagtaactcctgagttttggtttgctattatattaatggggatgcctctaacacagacagcaacacagatagcaattatatccaagtgtagacaacaagaaggaaaatggacacatgactctggatttctcttgtgagacctgggctccatttacaaacgtataaatcatcttgatataggtagtgattacaatttttgcatggatgagtcatccatgggtgaaagtggcataagaaaaggaagcttgggaataagccttaaagaattccagtatttaatggtcagctggaggatgattagcagaaagaaagaaagaaagaaagaaaagaaagagagagagagagagagagtgagtgtatggtgtttcggcgtgtgcgggatcctct

SEQ ID NO: 277074 - DNA, 445 bp, Homo sapiens
ggtcggggagggagcaggaggacacagagccaaagcctttctgaaccaagagggacaggaattgggtgaccgttaataacttgtaattttctgcctccaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgag

SEQ ID NO: 277075 - DNA, 483 bp, Homo sapiens
cgactgcgcagtgacatccgttatcatcgtgcatagcggttcctagcgtaagagactctcagctgatatcgtgatacctacgttcctcatgcgcttggcacagatccagccacagcatgaccatgaccttcttggtgctgtcttctgccatcagcagcttctgtgaatcaggagcccttgttaacttcttggatattgctcctcggtagggacctcttttgcctcatcctttcagacactcaattcaagtctagcagccctaaatctactctgatgtgaaagtaaaatgtggcaggtacaacaggttgcaggaaatgtcagcaccagctctacatcctacatctaaataattcctggaagagactcaaagctggtggaccattgtgaacttagtttttctgggcgtgaacaagaggagtcagtggccatgctcagagtcaactgagggagactcacacaaacctctctctgttgaggaatgca

SEQ ID NO: 277076 - DNA, 3673 bp, Homo sapiens
  misc_feature (2997)..(2997): n is a, c, g, or t
gaattcctcgacactgttggcctactggatttatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggaatgaaactctaaaagaatttaaagcaatggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggttatggtattaactggtcagtattcaatttgggtcaaatgggctcccccactggaaaggagtcaactcaccaccattgctggatcagggtcaatgctggggtccttcattgttctacttgctggtggtctcctctgccagaccataggatggccttacgtcttctatatctttggaggaattggctgtgcttgttgtcctctctggtttcctctcatttatgatgatcctgtgaatcatccctttatcagtgctggtgagaagagatacattgtgtgttcattggctcagcaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactccaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggccacccctgcaaagtttcagctgagctgggatctgaaggataatagttaactgttgtgggagactgagaggagaatattttaggaagaaagaacagcataagcaaaagtttcatggcaggagggagaaattagctatggccagagtatagagaataagggaagtatgatttgtgaggagnctgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttgatttaggtggattatttgatttagggaataaacctgacgggtcctattactaagtgagagagtgaaagatgtccagagtaactcctgagttttggtttgctattatattaatggggatgcctctaacacagacagcaacacagatagcaattatatccaagtgtagacaacaagaaggaaaatggacacatgactctggatttctcttgtgagacctgggctccatttacaaacgtataaatcatcttgatataggtagtgattacaatttttgcatggatgagtcatccatgggtgaaagtggcataagaaaaggaagcttgggaataagccttaaagaattccagtatttaatggtcagctggaggatgattagcagaaagaaagaaagaaagaaagaaaagaaagagagagagagagagagagtgagtgtatggtgtttcggcgtgtgcgggatcctct

SEQ ID NO: 277077 - DNA, 3684 bp, Homo sapiens
  misc_feature (3008)..(3008): n is a, c, g, or t
ttacctcccagaattagacaattgcaaagagcttagaatatttatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggaatgaaactctaaaagaatttaaagcaatggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggttatggtattaactggtcagtattcaatttgggtcaaatgggctcccccactggaaaggagtcaactcaccaccattgctggatcagggtcaatgctggggtccttcattgttctacttgctggtggtctcctctgccagaccataggatggccttacgtcttctatatctttggaggaattggctgtgcttgttgtcctctctggtttcctctcatttatgatgatcctgtgaatcatccctttatcagtgctggtgagaagagatacattgtgtgttcattggctcagcaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactccaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggccacccctgcaaagtttcagctgagctgggatctgaaggataatagttaactgttgtgggagactgagaggagaatattttaggaagaaagaacagcataagcaaaagtttcatggcaggagggagaaattagctatggccagagtatagagaataagggaagtatgatttgtgaggagnctgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttgatttaggtggattatttgatttagggaataaacctgacgggtcctattactaagtgagagagtgaaagatgtccagagtaactcctgagttttggtttgctattatattaatggggatgcctctaacacagacagcaacacagatagcaattatatccaagtgtagacaacaagaaggaaaatggacacatgactctggatttctcttgtgagacctgggctccatttacaaacgtataaatcatcttgatataggtagtgattacaatttttgcatggatgagtcatccatgggtgaaagtggcataagaaaaggaagcttgggaataagccttaaagaattccagtatttaatggtcagctggaggatgattagcagaaagaaagaaagaaagaaagaaaagaaagagagagagagagagagagtgagtgtatggtgtttcggcgtgtgcgggatcctct

SEQ ID NO: 277078 - DNA, 621 bp, Homo sapiens
ttacctcccagaattagacaattgcaaagagcttagaatatttatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggaatgaaactctaaaagaatttaaagcaatggtaagtttaatgagactctggactctttctttgactcaaataatttgacttaaagagttataaaagagtgagattcatttaaccactaagtatttactgaacatgtactatgtgccaggaatggcacaagtacctaagtatcaggccgagcatggtggctcacacctttagtcccagcactttgggagggtgaggcatctttact

SEQ ID NO: 277079 - DNA, 2780 bp, Homo sapiens
gggggcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctag

SEQ ID NO: 277080 - DNA, 3368 bp, Homo sapiens
ggctttggccctggaaagcctcgcggacgtgttctgacccaaggttttagcagtggatgtggcgttttcttccattccttctttcagtttttctgtactcgttgcttgcaattaagtgtaaatacttttgctagtggataatgggggaggcaaggactgagacctgcggtatgacgatagctctggctcttaatagtttgaggtaaagcgagatactctgagcttttgtctcccgtaaaaagggtggtgaatatgaataagggctttcttagcgttataagaattaaagggcatagttctgtggtgtgaaatctttaaaagatgttcagtaaataaaaatgattttcctccttcccctctcagacctctttttcttctttctttctttttttttgacaagttctcactcctctcacccaggctggagtctttctgaaagagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtttgttctgagtaatgaataccctattactatgacactagtatcttccttaattatcctactcattgtctcaacattctgaaagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctag

SEQ ID NO: 277081 - DNA, 1367 bp, Homo sapiens
ttttttttggcatggcttttttattctctttgcagccaagacctgtttttacaattaaaaccaaaattttgaatcacaaggttcctatgtctatgcatacttgggaacttagtgtgaggaaataatagttaattgaaatactagtggaactgttaaaccacaaatttagactaccaggagaaactgaattatttgatatattacatgtaatgatgcacgttatatattttacatatattacatatatatttttttaggtgaaatgggcccacttgactcactgaactttattttttagacagagtctcgctctgtcgcccagattggagtgtggtggtgtgatcatagctcgctataacctcaaactcctgggctcaagcattcctcccaccaaagtcctgggattagaggcatgagccaccacacttggcctacttatattacatctaagctggattttaagtacatgtgtatacactgctgttgccagtttcttagcttatacagtaaaggttagcagactatcattttttcctgcaaagacaactctataactaactattttgtaaggaagaacacagtagagtgatttaatccagattatactaagagtatttatagatcagtccatgtgacttccagaatttgcctagtatggttgaacactcagcacttaaattatgtggccatttcatatctagtagagtgctaacatgttgctatttgcttggtttttcatggtccctggcagactgggtttgtagatgaaactgaagctgccaaagtggaacgtgtgaaacaggaaaaaggtattttctgggaaccctttgctaatgtgactgtagaagaagcaaagaggtcatctttacaggtatgggctgatttcaataggggccaaactttaacaaggcaaattctgccctttttacttactgacgaaacaaaccagtgtggtttccagccttatgctgaatttcaaatcaaatagatctagacatgtaaaattctgttttatggtagttgcttttaaaattaagaagtgggactacaccatatcaaatatattctttcagtatgtttgaattattggtagtaacctttaagggaagttacatattgtaccagtgatgctataaatgcagtctttactgaaccacagaagaaaatgaaagaaacttactcctaaatgtttagtttgattccttgccttattaatcaaatgagtctcctaataatttttggcagtaactgaagatcacatctacttattaaaaggcagaatttgacaccaataaggatattcaaaatattgttttgagcactattagtatagtaattagtatagtagtaattcatgaagaacaaca

SEQ ID NO: 277082 - DNA, 571 bp, Homo sapiens
cttggatcccccccttagggtaactcacacgcttcgatccacaatatagggaaaaacatttgggaaccctgtctatatggctatatcaccccaaaatgcctttacatatttttctagatgactgtgtaggggttttggggtgcatcctcctacccttgtgatccaatgactagaataaaatttgcatgtaagctttactccagtccaaaaggaaggttctttatatttagaatggatattgtgatattacttatgttttttttccagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctag

SEQ ID NO: 277083 - DNA, 524 bp, Homo sapiens
  misc_feature (1)..(1): n is a, c, g, or t
  misc_feature (15)..(15): n is a, c, g, or t
  misc_feature (24)..(24): n is a, c, g, or t
  misc_feature (46)..(46): n is a, c, g, or t
  misc_feature (60)..(60): n is a, c, g, or t
  misc_feature (90)..(90): n is a, c, g, or t
  misc_feature (98)..(98): n is a, c, g, or t
nccagattcccttangggcccaanttcttaaagaaaaggttcccanagtgtcccaagttntaaaaaaacttaaggaccaaagtggacccnttctgganaaactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctag

SEQ ID NO: 277084 - DNA, 432 bp, Homo sapiens
tgactttcaaaccattttaatatttcaaatattccagaacaatcccaaaacatttattgaactgcttctgtattgcaatcggaaaattgtctgaagggtacattactcgttatctcttttacagcttctcaaaatgaggcttagataaatgaagtgaatttcgtaaggtcctctgaataaacaaggaccagaacaggcatacacagcaggcctactgatacagacagacacagacacagtcttccagcagatagtatttttgggtcaaatgataatacatttcattttgtgctatcagtcataagggttaggctgatgaacctaaacctgtaagatgggttgctcctttactcttactgcatttgctgtatagtcatgcctatgatcataagggagtccagaagcattagtatgacccagcagaagtaatta

SEQ ID NO: 277085 - DNA, 3896 bp, Homo sapiens
gggggcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatccctttttttctttttcaaataaaaaggttacaatagctcattaaacaaactaa

SEQ ID NO: 277086 - DNA, 2165 bp, Homo sapiens
ttttttttggcatggcttttttattctctttgcagccaagacctgtttttacaattaaaaccaaaattttgaatcacaaggttcctatgtctatgcatacttgggaacttagtgtgaggaaataatagttaattgaaatactagtggaactgttaaaccacaaatttagactaccaggagaaactgaattatttgatatattacatgtaatgatgcacgttatatattttacatatattacatatatatttttttaggtgaaatgggcccacttgactcactgaactttattttttagacagagtctcgctctgtcgcccagattggagtgtggtggtgtgatcatagctcgctataacctcaaactcctgggctcaagcattcctcccaccaaagtcctgggattagaggcatgagccaccacacttggcctacttatattacatctaagctggattttaagtacatgtgtatacactgctgttgccagtttcttagcttatacagtaaaggttagcagactatcattttttcctgcaaagacaactctataactaactattttgtaaggaagaacacagtagagtgatttaatccagattatactaagagtatttatagatcagtccatgtgacttccagaatttgcctagtatggttgaacactcagcacttaaattatgtggccatttcatatctagtagagtgctaacatgttgctatttgcttggtttttcatggtccctggcagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatccctttttttctttttcaaataaaaaggttacaatagctcattaaacaaactaa

SEQ ID NO: 277087 - DNA, 3871 bp, Homo sapiens
gggggcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgagcaaattttgaggaaaactgcatcactggggagacatcatccttttttgggaccatttctgtcctcagttcaggtaatataagaaaagcagcagaaggcttaatttctgggatcatatcagcaaaccaatccatctcaggatcttttactggcttcttttttacttgaatggtgaattcctctcctaaaccaagttctgatggaaccttaaggggcctttcttgtgatgatacttttggcggctcgatttggtctgcgtcatcccccctttgtacaaggctaatctttcggggtaagcttgatttccaaggcatagactcttcagtgagtgaaagcaaagcaggaataggcttctgctcccctgaggtaacaggttttgtagcagtgattccacctcctgggtttactttagtatctaagctgctgggctcgcagtcatcccaagatgactcttccacatccaaggtagtgcactgggacttgacatcatcacaaggttctctaggccaaatctgtatgttgacagtttgatt

SEQ ID NO: 277088 - DNA, 2467 bp, Homo sapiens
cttaactgtacaaggtgacgagtatataggaaaataagacttattggtaagtaggagcatgataagatatctgacataactaataatgaaatacattatttaatgtcttggtgcatttatattgtgctccacttaagctgtgtttttgttttggaaaccaatgcagcatcaataacaataataataaagcatgttcatttatgttaccttggtctggaatgtagatattaccgtaccattataaagctttctcgaaatattaaatgtggaaactaatacttagcttttgtgtatccattcctctgacttgtctcatgttactcttctttctttaacaatttatttcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatccctttttttctttttcaaataaaaaggttacaatagctcattaaacaaactaa

SEQ ID NO: 277089 - DNA, 1807 bp, Homo sapiens
gagcacagtgctgacgacttttactaagcaattgaggccacagaagtaaaacacttggggccaggcgcggcggctacttatattacatctaagctggattttaagtacatgtgtatacactgctgttgccagtttcttagcttatacagtaaaggttagcagactatcattttttcctgcaaagacaactctataactaactattttgtaaggaagaacacagtagagtgatttaatccagattatactaagagtatttatagatcagtccatgtgacttccagaatttgcctagtatggttgaacactcagcacttaaattatgtggccatttcatatctagtagagtgctaacatgttgctatttgcttggtttttcatggtccctggcagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatccctttttttctttttcaaataaaaaggttacaatagctcattaaacaaactaa

SEQ ID NO: 277090 - DNA, 1019 bp, Homo sapiens
cgcgtcgactcttttttttttttttctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatccctttttttctttttcaaataaaaaggttacaatagctcattaaacaaactaa

SEQ ID NO: 277091 - DNA, 2972 bp, Homo sapiens
gggggcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacaggtatgggctgatttcaataggggccaaactttaacaaggcaaattctgccctttttacttactgacgaaacaaaccagtgtggtttccagccttatgctgaatttcaaatcaaatagatctagacatgtaaaattctgttttatggtagttgcttttaaaattaagaagtgggactacaccatatcaaatatattctttcagtatgtttgaattattggtagtaacctttaagggaagttacatattgtaccagtgatgctataaatgcagtctttactgaaccacagaagaaaatgaaagaaacttactcctaaatgtttagtttgattccttgccttattaatcaaatgagtctcctaataatttttggcagtaactgaagatcacatctacttattaaaaggcagaatttgacaccaataaggatattcaaaatattgttttgagcactattagtatagtaattagtatagtagtaattcatgaagaacaaca

SEQ ID NO: 277092 - DNA, 1004 bp, Homo sapiens
agcgctcgtctgcaggtcattgcttttcaccggcatgctgcggaggtgcagcggcgggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatccctttttttctttttcaaataaaaaggttacaatagctcattaaacaaactaa

SEQ ID NO: 277093 - DNA, 812 bp, Homo sapiens
gggggcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagtttcagaccttctccaggctcttttcaaggaggcctattctcttcaaaagcagttaatggaactgctggacatggtttgcatggaccctttagtagatgacaatgatgatattttgaatatggtaataggtgagtgaagaaaactttctgcttagtatatggtgactataaatcatgtatcaattaaaattgtctctaatgattcatgttattttcttactaattatgcattaaaattgatttaaatcttaccaaataaatt

SEQ ID NO: 277094 - DNA, 516 bp, Homo sapiens
gccatgaagtgaacacatgctgttgcagaaatggtacaggtagacttgttcagtacagagttgccacacaccttatatttctaaaaaaaaaaaaaaaaaaaaaaaaaaagcagtatcttcaaattgcaataaatcaaagcacaataaaatactgtttgtacaaaatatgttttaaaggtttggtatataaagtttttcagaaacatgtatacttttattttttacgtggttggaggcaggagggtgtggtaagaataatgctttaactgttaacttgttcataggattgtcttatttaaattctaccagtgaagttcaggggctgtggtgtgtttgtttttttctgggtttggttttgtttcccctccccacatttccatccaaatcttaggcagttattgtgtctgtacaaaatactggtattatttataactgttctttggtcttcacctctgtaggcagtaactttgcagacctcgctacttaaattagagcttcctgactatgttcgtttgg

SEQ ID NO: 277095 - DNA, 737 bp, Homo sapiens
gcaataaacaataacaacatgatgatatgtgcagtatattaaatggtggtgagtgctatggagaaaaataaagcagggaaggaagatagggaatatgaatgtgggggtccaatttgaaatgggatatatagttagtgaagtcctcaccaaggtgacatgcaagtaaaaacctgaaatgcaaagcactggagatgggagcatgcctcatattcagggaagcaagtatagctaacacaaaggtagcaggactttgcaggtcatttgaggactttggctttcactaacaagggaaatagggagctactggaaggatttgagtaaaagagtgacattacctaatatgttttagtgtgtgtcccctgggacaggattatgttaacttgacaacactgggcttattgaatgtatggctattttatgattatctattatggtttcttttctctattataataaggcttggttcttttaggacagaattctgcccaacctgtcctgtatgtttgccttactgctagctgacaggagttggctgctagaacaacataccttggaggcgtttactcagttcgctgaggtaattataaaactgatttatcacagtgactttcaaaccattttaatatttcaaatattccagaacaatcccaaaacatttattgaactgcttctgtattgcaatcggaaaattgtctgaagggtacattactcgttatctcttttacagcttctcaaaa

SEQ ID NO: 277096 - DNA, 440 bp, Homo sapiens
ctctctctaaaaaaaaataaataaataaatcataaacctgtggattattgtagcattgtttctcatctgtcaaaaatatttcatgactatgcatagtttgaaaaggcaagtttgtccctgggcaattttcaaaatatttctttaatgtgttttcacaatactgtttacctaataaatcttaagtttttaaaagcaaaattaagccagtaatttgagtccaattccaatctcttatgagtcattgcttaaatttcaaaagggttttattttttttttaggtttgttctgagtaatgaataccctattactatgacactagtatcttccttaattatcctactcattgtctcaacattctgaaagttggattgagcatattcgtaagtaaaattgttttaactgtatgatgtactttgatgttaaggtccgagtccccacat

SEQ ID NO: 277097 - DNA, 914 bp, Homo sapiens
  misc_feature (2)..(2): n is a, c, g, or t
gnggtcccggaacaaatccgaccccagaagtggggacttctggccctcacctccccatttgaatgtaatgtttacagtgatccagacctggggatgcttgcttcccgacgtgtcctgggatcgcgcttctgaaaaagctcacctcacaacgcctcctccggacctaaatcgcgcaccagtttgttctgagtaatgaataccctattactatgacactagtatcttccttaattatcctactcattgtctcaacattctgaaagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaataggtgagtgaagaaaactttctgcttagtatatggtgactataaatcatgtatcaattaaaattgtctctaatgattcatgttattttcttactaattatgcattaaaattgatttaaatcttaccaaataaatt

SEQ ID NO: 277098 - DNA, 3770 bp, Homo sapiens
gggggcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatccctttttttctttttcaaataaaaaggttacaatagctcattaaacaaactaa

SEQ ID NO: 277099 - DNA, 3973 bp, Homo sapiens
  misc_feature (239)..(239): n is a, c, g, or t
ccttcgagaatcttgctagaccattcggtatgtgctgcgcgtgctgccacgttaggtaaaggtcatgcattgggtcaatcatccttcgtgtcctgaaggagaatctcattggttctctgagcataggttgcttgtcacttactctacgcagactagatataaaccgtcgccggcagagttaaacctgaagcctgttctagaagcgaagactcctaggcactgcgcaggttacatcgtangctgctatctgatctcgtggactctagtcatccatgcgtacgattcgtgtcgagcatctgcattgatcaattgtgactcgcccgctctgcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatccctttttttctttttcaaataaaaaggttacaatagctcattaaacaaactaa

SEQ ID NO: 277100 - DNA, 3961 bp, Homo sapiens
  misc_feature (2)..(2): n is a, c, g, or t
gnggtcccggaacaaatccgaccccagaagtggggacttctggccctcacctccccatttgaatgtaatgtttacagtgatccagacctggggatgcttgcttcccgacgtgtcctgggatcgcgcttctgaaaaagctcacctcacaacgcctcctccggacctaaatcgcgcaccagtttgttctgagtaatgaataccctattactatgacactagtatcttccttaattatcctactcattgtctcaacattctgaaagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatccctttttttctttttcaaataaaaaggttacaatagctcattaaacaaactaa

SEQ ID NO: 277101 - DNA, 4011 bp, Homo sapiens
gggggcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctcagtaatttctgctgcagcaaattttgaggaaaactgcatcactggggagacatcatccttttttgggaccatttctgtcctcagttcaggtaatataagaaaagcagcagaaggcttaatttctgggatcatatcagcaaaccaatccatctcaggatcttttactggcttcttttttacttgaatggtgaattcctctcctaaaccaagttctgatggaaccttaaggggcctttcttgtgatgatacttttggcggctcgatttggtctgcgtcatcccccctttgtacaaggctaatctttcggggtaagcttgatttccaaggcatagactcttcagtgagtgaaagcaaagcaggaataggcttctgctcccctgaggtaacaggttttgtagcagtgattccacctcctgggtttactttagtatctaagctgctgggctcgcagtcatcccaagatgactcttccacatccaaggtagtgcactgggacttgacatcatcacaaggttctctaggccaaatctgtatgttgacagtttgatt

SEQ ID NO: 277102 - DNA, 421 bp, Homo sapiens
gttttacaaagaagttttgcctttattaataagaaaccagtgatgtttagtttggaataactttttttaaaatgttatgtctttgaatgtcatgttagccttttactgcagggcccacttagagaggctgataaaagctataaaccctcctccttcctgctccccatgccctctcaaatctcaaacacacacagaaaattgaatatagtattgggaggtttttgacttccttgaagtctgttcattaacttcttaaaggttcatattgatattgcacaggaggctgctgagggtgaagcagcctcagattttggggcctaaaggatggtgctgagggtctggctccatgtcctcctcgtcctcggggaaaggcggcctgatttggcaggggggaagagggccttgcgctgacggaggcatg

SEQ ID NO: 277103 - DNA, 237 bp, Homo sapiens
accattctaaatccttggtaagggctccgtgcagtagttaaccccccaaatccgactaaggagagcaggacggcggaacccgggtgccctaatcaaatatgggcaccaaggaaggaaaaaagcgtccgcatctgctcgctggtcaccgccgacgacagattcgtcacctgaatcaccgacgtgggggtgaggccgaagcctaagcccaaaccgaagccgccgccgctgttcatcccg

SEQ ID NO: 277104 - DNA, 1302 bp, Homo sapiens
aagttagaaagaacctgagacgtgacactgaaaatcagtagaagaaatacgccacatttattctaccggggaagacagtgggaaacctgaaactgccattgagcagaaggaaaacatccctttccagaacctttctcgtttttctaaaaatctgcacttttggaagtgatcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagagagtcttgctctgtcacccaggctgaagtgcacccaggctgaagttggaggctatggtgagctgcaccactacaccactatgggaggccgaggcgagtggattgcctgagctcaggagttcgagaccagcctgggcaacgttgtgaaaccccgtctctactaaaacacaaaaaattagccaggcctggcggcatgtgcctatagtcccagctactcaggaggctgaggcaggagaattgcttgaacccgggagctggaggttgcagtgagccgagattgcgccactgcactccagcctcggtgacagagtgagactccgtctcaaaaaaaaacaatataaggtgaaggccaagcagggtggcacatacctgttgtctcacctactcaaaaggctgaggccagaggaggattgctggaagtgagttcaaagccagcctagagaatatattgagactctgtctctaaattttatatatatatggtgaattcacctttaccatatcttttatgtataagcaatgggattgattagcaagtaatgggactctgaaatcaaaggggtaaatttgggtatatctttataaatataataaccttgaaccccacaaatctctctaagcgtcctttaaaaaatagactttctgtctgagtaggtgagtccttttttttgtttgaagatactagaaagctcttacttgagacagctcctaaaagaatgtcaattcaacagaagtctcatagccagtataactaattctaaccccctaactagagtcagatactaggatacccctaagggacaacaatgaaatctgaatttgggtgtcattgcttacatatcaaaacagttgcaagagacagttaatttatatttgcagaaaccatatgaatttgtatgaaaatgattttttaaagtgctatatcaagaaaactagaacataatgcagaacaaataaaatttacttatatgggtg

SEQ ID NO: 277105 - DNA, 541 bp, Homo sapiens
aagttagaaagaacctgagacgtgacactgaaaatcagtagaagaaatacgccacatttattctaccggggaagacagtgggaaacctgaaactgccattgagcagaaggaaaacatccctttccagaacctttctcgtttttctaaaaatctgcacttttggaagtgatcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagagagatggggtttcaccatgttggccaggatgtctcaatctctcgacctcgtgatccgcctgcctcagcctctcaaagtgctaggattatagaagtgagccaccacgctcggcaaatgtttcaattttattcacaaaagtatactttacccaattgttgtaaactataaatattaatgtttaaaataaaatttttcttgactcaaaaacaaaac

SEQ ID NO: 277106 - DNA, 4208 bp, Homo sapiens
aagttagaaagaacctgagacgtgacactgaaaatcagtagaagaaatacgccacatttattctaccggggaagacagtgggtaagaaaaaaataccgtaacatttaaattaaaaaataattaaaaatttaaaagcaaatagaaattaaaacaaaatacactgataacctcgctgccagaacaagatacaccaaaaaaaaattttttttttgattatacaaaacatacaaagcatcctacaaacagaaagaaattgcaaacagggtcgaatggtgagatcctaccattatatttgtcagcactaaacccgtgcctcttgcgcctatccgaagtttcctcggattaagaagaaacagccatggttaaaccggtatttgcgacaccaacaattatctgtagccgacgtaccccaacttctacatgagtgaaaaatcgccagcatagccagggcgagactattgcgaattctaacttggtatgatttaaaaattccagacactgctaaatttttttaaattgcattcttcagtacctagattaatacaggagttataaaccgcacgcatggctataatgggggctcctattacggaacaggaatttgctactactaaaattatgtaggcatggttaaagccagaattgttacaaccagaaatcgcaaactggaataactctcaacttgctacggtaagaaataactaaactctgacttggtcagactaagaaatcaggagtttgagaccagcccaggcaacatggcgaaatcctgtctctaggaaggatacaaaaaattacccgggcgtggtggcgcgtgcctgtggtcccagctaccccggaggctggggtgggaggatcgcttcagcccgggaggcggaggttgcagtgagccgagatcgcggcactgcactccagcctgggcgacagagccggaccccgtatcaagaaagaaagagaaaagaaaaagaaccaaagaaaaagaaaagtcaccatcgcacggttaagtctgccttgctacagctaaacagtgacttcctaggaccaagaaatcgcagccagggctagaccgatgccctaaatcgggacttgcttaggctgagaaatcacattttggctagttatttggacaagaggtagaaatagcgggcaccgcgaaatcgaaacttgctaggaccaagaagccaacgacgggcgaaaccgcaggggcctgcgatagagacgccagcggcgccgccgggggactgggttcaggaggccgagcaggaacccgtgcgtcggcgctcgcggcgctgtgaagagacggcgtccgcgcagctcctctgcctctggctcggaggagcggcgggctcccccgcccagcgccggcgtcgcccgggaaccccagactctgcgcaactggctgcgattccaaatccctcagatcggctaccagagcgctgccgccaccgagaaaatggaggcaccgaggaacaagatgtgccgcgaccaagagaactcggcttggcgaaatggcggtgctgggaccctaagagtgacgccagccggaggagttcccaaggacaacatccattttggcggaaccaacggtgttgtcacgcagaaaatgtcgaccctcggaaaagagaggttctgcgaccgagaaattcggtgcaacaagtgctgtgacagaaaaccccccgctcggcgctgctggcgaaagagccaacaaaacgctgggtgctgccaccgtgacaccgactttaggaccccggcctcggatggagaaaggagggtacggagccaccacataacttcctaatgtcttcaaatagcgaaagtgctagccggaaactgccggctgggtttacctattggtgctcgtgtgggactagcagattcgagaaaccagcgggactggaacctagtacacttcgggcagttgagaaatgacttaccaggacaaatactgcttctggctcgatggtgctgcccatgaacatccgccggctctgagaaacgagctgcactgtcagtgagaaaccgtgggcactgagaaacgagcggactgcaactgataactgcccacccagtgccactacgacaaagtgctgctggcactactcccaccctccgtcctcaaatcagtcccctcccgcctaagaagacctttatttttcctagcgaagtcatactgagggccccatcaaccgatcccttgcgatgcgcatgggaaaaggaggcagtatagggaccgagaatcgggcggattgggctggccctggtaacaaaagccatccgggtcgccaaccgtcttccactgcaagaaacaaaccttccagtggctgggctccgcccttctccttggtcagagccctccaggctcctaagggcgaagccgacacctcatccctttggaacttgaagttctcagtccaagacctccgtggagagtgaaagactcaatgcctcctgaccgaggcttcaggcctgccccggcagctaggaaacctgaaactgccattgagcagaaggaaaacatccctttccagaacctttctcgtttttctaaaaatctgcacttttggaagtgatcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagagggtaagaagacccattttgggctctcacttctcacccactcccaagatggtcacctccagtcttcccccctataccttaccctttcttcagctagccaaaacctgccctggtacttgaggcttcttcagttgccttcttttgcaggcagtagaataaaggaaagagggcagtgtcaatagaagaaaagttacagccactttatctaattgaagatactgtgcagagcctttgaaaaaacaaaatatctcacccaccattcctctctccgtttccaccctagcttcctattttagcaaaaatggtgggatcagcacctctggagggaaggggtcactcttccaggttaggaatgtggacaggagttatggagcttacttccctaaaggaggaggcattctagttccggcattcagattctgtctgattccaatatggtgtttgtgtggggtggtcagagaaagggcaagtcggcaactgtatattcctcagcaagagactataagacatttgcatttggaaaatcaggagagatgctgatatggtttggctccgtgtccccacccaaatctcaccttgaattgtaataatccccatgtgtcaagggtgagaccaggtggagataattgaatcatggggttggttttccccatgctgttctcgtgttagtgagtgggtctcacgagatctgatagttttataattgcctggcattttcccctgctggcacacattctcctgcggccctctgaagaggtgccttccatcacgattgtaagtttcctgaggcctccccagccatgcagagctttgagtcaattaaaacttctttctttataaattacccagtcttggatatttcttcatagcagtgtgggaacagactaatacagatgtggtagagttgggtgctgggtggcaatgctaagtgtatgcaggttctaggcaccagatcaaatctggaatgcaaactgtgggacacaaaccacaaatgatgcccagcctttaatactttctttcattgtttgtcatatagaagaagaaacaaagaataaagaaaagcattttttttgagacggagtctcgctctgttccccaggctggagtgtagtggtacgatctcggctcactgcaacatccacctcccaggttcaagttattctcctgcctcagctcccaagcagccaggattacaggtgcataccatcacacctggcttatttttgtatttttagtaaagacagggtttcaccctgttggccaggctggtctcaaagtcctgacctcaagtgatccacctgcttcggcctctcaaagtgctggaattacaggcatgagtcacagtgcccagccgcaaagtatatttttgtaaaatttcatcaagataaatctggctaaaccaataaactaataataacaaaacttgggttattgttgactaaaggaaggtggcacaaaatggaaacatttttaaacattc

SEQ ID NO: 277107 - DNA, 3397 bp, Homo sapiens
aagttagaaagaacctgagacgtgacactgaaaatcagtagaagaaatacgccacatttattctaccggggaagacagtgggtaagaaaaaaataccgtaacatttaaattaaaaaataattaaaaatttaaaagcaaatagaaattaaaacaaaatacactgataacctcgctgccagaacaagatacaccaaaaaaaaattttttttttgattatacaaaacatacaaagcatcctacaaacagaaagaaattgcaaacagggtcgaatggtgagatcctaccattatatttgtcagcactaaacccgtgcctcttgcgcctatccgaagtttcctcggattaagaagaaacagccatggttaaaccggtatttgcgacaccaacaattatctgtagccgacgtaccccaacttctacatgagtgaaaaatcgccagcatagccagggcgagactattgcgaattctaacttggtatgatttaaaaattccagacactgctaaatttttttaaattgcattcttcagtacctagattaatacaggagttataaaccgcacgcatggctataatgggggctcctattacggaacaggaatttgctactactaaaattatgtaggcatggttaaagccagaattgttacaaccagaaatcgcaaactggaataactctcaacttgctacggtaagaaataactaaactctgacttggtcagactaagaaatcaggagtttgagaccagcccaggcaacatggcgaaatcctgtctctaggaaggatacaaaaaattacccgggcgtggtggcgcgtgcctgtggtcccagctaccccggaggctggggtgggaggatcgcttcagcccgggaggcggaggttgcagtgagccgagatcgcggcactgcactccagcctgggcgacagagccggaccccgtatcaagaaagaaagagaaaagaaaaagaaccaaagaaaaagaaaagtcaccatcgcacggttaagtctgccttgctacagctaaacagtgacttcctaggaccaagaaatcgcagccagggctagaccgatgccctaaatcgggacttgcttaggctgagaaatcacattttggctagttatttggacaagaggtagaaatagcgggcaccgcgaaatcgaaacttgctaggaccaagaagccaacgacgggcgaaaccgcaggggcctgcgatagagacgccagcggcgccgccgggggactgggttcaggaggccgagcaggaacccgtgcgtcggcgctcgcggcgctgtgaagagacggcgtccgcgcagctcctctgcctctggctcggaggagcggcgggctcccccgcccagcgccggcgtcgcccgggaaccccagactctgcgcaactggctgcgattccaaatccctcagatcggctaccagagcgctgccgccaccgagaaaatggaggcaccgaggaacaagatgtgccgcgaccaagagaactcggcttggcgaaatggcggtgctgggaccctaagagtgacgccagccggaggagttcccaaggacaacatccattttggcggaaccaacggtgttgtcacgcagaaaatgtcgaccctcggaaaagagaggttctgcgaccgagaaattcggtgcaacaagtgctgtgacagaaaaccccccgctcggcgctgctggcgaaagagccaacaaaacgctgggtgctgccaccgtgacaccgactttaggaccccggcctcggatggagaaaggagggtacggagccaccacataacttcctaatgtcttcaaatagcgaaagtgctagccggaaactgccggctgggtttacctattggtgctcgtgtgggactagcagattcgagaaaccagcgggactggaacctagtacacttcgggcagttgagaaatgacttaccaggacaaatactgcttctggctcgatggtgctgcccatgaacatccgccggctctgagaaacgagctgcactgtcagtgagaaaccgtgggcactgagaaacgagcggactgcaactgataactgcccacccagtgccactacgacaaagtgctgctggcactactcccaccctccgtcctcaaatcagtcccctcccgcctaagaagacctttatttttcctagcgaagtcatactgagggccccatcaaccgatcccttgcgatgcgcatgggaaaaggaggcagtatagggaccgagaatcgggcggattgggctggccctggtaacaaaagccatccgggtcgccaaccgtcttccactgcaagaaacaaaccttccagtggctgggctccgcccttctccttggtcagagccctccaggctcctaagggcgaagccgacacctcatccctttggaacttgaagttctcagtccaagacctccgtggagagtgaaagactcaatgcctcctgaccgaggcttcaggcctgccccggcagctaggaaacctgaaactgccattgagcagaaggaaaacatccctttccagaacctttctcgtttttctaaaaatctgcacttttggaagtgatcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagagagtgagactccgtctcaaaaaaaaacaatataaggtgaaggccaagcagggtggcacatacctgttgtctcacctactcaaaaggctgaggccagaggaggattgctggaagtgagttcaaagccagcctagagaatatattgagactctgtctctaaattttatatatatatggtgaattcacctttaccatatcttttatgtataagcaatgggattgattagcaagtaatgggactctgaaatcaaaggggtaaatttgggtatatctttataaatataataaccttgaaccccacaaatctctctaagcgtcctttaaaaaatagactttctgtctgagtaggtgagtccttttttttgtttgaagatactagaaagctcttacttgagacagctcctaaaagaatgtcaattcaacagaagtctcatagccagtataactaattctaaccccctaactagagtcagatactaggatacccctaagggacaacaatgaaatctgaatttgggtgtcattgcttacatatcaaaacagttgcaagagacagttaatttatatttgcagaaaccatatgaatttgtatgaaaatgattttttaaagtgctatatcaagaaaactagaacataatgcagaacaaataaaatttacttatatgggtg

SEQ ID NO: 277108 - DNA, 3201 bp, Homo sapiens
aagttagaaagaacctgagacgtgacactgaaaatcagtagaagaaatacgccacatttattctaccggggaagacagtgggtaagaaaaaaataccgtaacatttaaattaaaaaataattaaaaatttaaaagcaaatagaaattaaaacaaaatacactgataacctcgctgccagaacaagatacaccaaaaaaaaattttttttttgattatacaaaacatacaaagcatcctacaaacagaaagaaattgcaaacagggtcgaatggtgagatcctaccattatatttgtcagcactaaacccgtgcctcttgcgcctatccgaagtttcctcggattaagaagaaacagccatggttaaaccggtatttgcgacaccaacaattatctgtagccgacgtaccccaacttctacatgagtgaaaaatcgccagcatagccagggcgagactattgcgaattctaacttggtatgatttaaaaattccagacactgctaaatttttttaaattgcattcttcagtacctagattaatacaggagttataaaccgcacgcatggctataatgggggctcctattacggaacaggaatttgctactactaaaattatgtaggcatggttaaagccagaattgttacaaccagaaatcgcaaactggaataactctcaacttgctacggtaagaaataactaaactctgacttggtcagactaagaaatcaggagtttgagaccagcccaggcaacatggcgaaatcctgtctctaggaaggatacaaaaaattacccgggcgtggtggcgcgtgcctgtggtcccagctaccccggaggctggggtgggaggatcgcttcagcccgggaggcggaggttgcagtgagccgagatcgcggcactgcactccagcctgggcgacagagccggaccccgtatcaagaaagaaagagaaaagaaaaagaaccaaagaaaaagaaaagtcaccatcgcacggttaagtctgccttgctacagctaaacagtgacttcctaggaccaagaaatcgcagccagggctagaccgatgccctaaatcgggacttgcttaggctgagaaatcacattttggctagttatttggacaagaggtagaaatagcgggcaccgcgaaatcgaaacttgctaggaccaagaagccaacgacgggcgaaaccgcaggggcctgcgatagagacgccagcggcgccgccgggggactgggttcaggaggccgagcaggaacccgtgcgtcggcgctcgcggcgctgtgaagagacggcgtccgcgcagctcctctgcctctggctcggaggagcggcgggctcccccgcccagcgccggcgtcgcccgggaaccccagactctgcgcaactggctgcgattccaaatccctcagatcggctaccagagcgctgccgccaccgagaaaatggaggcaccgaggaacaagatgtgccgcgaccaagagaactcggcttggcgaaatggcggtgctgggaccctaagagtgacgccagccggaggagttcccaaggacaacatccattttggcggaaccaacggtgttgtcacgcagaaaatgtcgaccctcggaaaagagaggttctgcgaccgagaaattcggtgcaacaagtgctgtgacagaaaaccccccgctcggcgctgctggcgaaagagccaacaaaacgctgggtgctgccaccgtgacaccgactttaggaccccggcctcggatggagaaaggagggtacggagccaccacataacttcctaatgtcttcaaatagcgaaagtgctagccggaaactgccggctgggtttacctattggtgctcgtgtgggactagcagattcgagaaaccagcgggactggaacctagtacacttcgggcagttgagaaatgacttaccaggacaaatactgcttctggctcgatggtgctgcccatgaacatccgccggctctgagaaacgagctgcactgtcagtgagaaaccgtgggcactgagaaacgagcggactgcaactgataactgcccacccagtgccactacgacaaagtgctgctggcactactcccaccctccgtcctcaaatcagtcccctcccgcctaagaagacctttatttttcctagcgaagtcatactgagggccccatcaaccgatcccttgcgatgcgcatgggaaaaggaggcagtatagggaccgagaatcgggcggattgggctggccctggtaacaaaagccatccgggtcgccaaccgtcttccactgcaagaaacaaaccttccagtggctgggctccgcccttctccttggtcagagccctccaggctcctaagggcgaagccgacacctcatccctttggaacttgaagttctcagtccaagacctccgtggagagtgaaagactcaatgcctcctgaccgaggcttcaggcctgccccggcagctaggtacctctccaggggatggaactctgtgggaactgctatttaattctgatggttaactctgtcagatggccttgatatatgggaataatcgttgcaggagggtaggggaaataagaatcgcaagactctagcacaggacgtgtggattgatggaaacctgaaactgccattgagcagaaggaaaacatccctttccagaacctttctcgtttttctaaaaatctgcacttttggaagtgatcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagaggacaacaactcgggatccacctaacacgggtacaaagaaggctgtaacacgggaagcagctgttgggccaaaccagccctggagctgtaggccagagcaagaccacaggactgacagagctgttaacacgctgacatctttcgggctgcagagggcgggactgaaagagctattagcatgttgtaacacccactctggggctttggggtcacgggcatccctgtttgggtgccatcacattcccctcatctggatgccagagtccaccataggagtcacttgcaacatgcctggtccagccacaagtcccacacagagc

SEQ ID NO: 277109 - DNA, 3901 bp, Homo sapiens
aagttagaaagaacctgagacgtgacactgaaaatcagtagaagaaatacgccacatttattctaccggggaagacagtgggtaagaaaaaaataccgtaacatttaaattaaaaaataattaaaaatttaaaagcaaatagaaattaaaacaaaatacactgataacctcgctgccagaacaagatacaccaaaaaaaaattttttttttgattatacaaaacatacaaagcatcctacaaacagaaagaaattgcaaacagggtcgaatggtgagatcctaccattatatttgtcagcactaaacccgtgcctcttgcgcctatccgaagtttcctcggattaagaagaaacagccatggttaaaccggtatttgcgacaccaacaattatctgtagccgacgtaccccaacttctacatgagtgaaaaatcgccagcatagccagggcgagactattgcgaattctaacttggtatgatttaaaaattccagacactgctaaatttttttaaattgcattcttcagtacctagattaatacaggagttataaaccgcacgcatggctataatgggggctcctattacggaacaggaatttgctactactaaaattatgtaggcatggttaaagccagaattgttacaaccagaaatcgcaaactggaataactctcaacttgctacggtaagaaataactaaactctgacttggtcagactaagaaatcaggagtttgagaccagcccaggcaacatggcgaaatcctgtctctaggaaggatacaaaaaattacccgggcgtggtggcgcgtgcctgtggtcccagctaccccggaggctggggtgggaggatcgcttcagcccgggaggcggaggttgcagtgagccgagatcgcggcactgcactccagcctgggcgacagagccggaccccgtatcaagaaagaaagagaaaagaaaaagaaccaaagaaaaagaaaagtcaccatcgcacggttaagtctgccttgctacagctaaacagtgacttcctaggaccaagaaatcgcagccagggctagaccgatgccctaaatcgggacttgcttaggctgagaaatcacattttggctagttatttggacaagaggtagaaatagcgggcaccgcgaaatcgaaacttgctaggaccaagaagccaacgacgggcgaaaccgcaggggcctgcgatagagacgccagcggcgccgccgggggactgggttcaggaggccgagcaggaacccgtgcgtcggcgctcgcggcgctgtgaagagacggcgtccgcgcagctcctctgcctctggctcggaggagcggcgggctcccccgcccagcgccggcgtcgcccgggaaccccagactctgcgcaactggctgcgattccaaatccctcagatcggctaccagagcgctgccgccaccgagaaaatggaggcaccgaggaacaagatgtgccgcgaccaagagaactcggcttggcgaaatggcggtgctgggaccctaagagtgacgccagccggaggagttcccaaggacaacatccattttggcggaaccaacggtgttgtcacgcagaaaatgtcgaccctcggaaaagagaggttctgcgaccgagaaattcggtgcaacaagtgctgtgacagaaaaccccccgctcggcgctgctggcgaaagagccaacaaaacgctgggtgctgccaccgtgacaccgactttaggaccccggcctcggatggagaaaggagggtacggagccaccacataacttcctaatgtcttcaaatagcgaaagtgctagccggaaactgccggctgggtttacctattggtgctcgtgtgggactagcagattcgagaaaccagcgggactggaacctagtacacttcgggcagttgagaaatgacttaccaggacaaatactgcttctggctcgatggtgctgcccatgaacatccgccggctctgagaaacgagctgcactgtcagtgagaaaccgtgggcactgagaaacgagcggactgcaactgataactgcccacccagtgccactacgacaaagtgctgctggcactactcccaccctccgtcctcaaatcagtcccctcccgcctaagaagacctttatttttcctagcgaagtcatactgagggccccatcaaccgatcccttgcgatgcgcatgggaaaaggaggcagtatagggaccgagaatcgggcggattgggctggccctggtaacaaaagccatccgggtcgccaaccgtcttccactgcaagaaacaaaccttccagtggctgggctccgcccttctccttggtcagagccctccaggctcctaagggcgaagccgacacctcatccctttggaacttgaagttctcagtccaagacctccgtggagagtgaaagactcaatgcctcctgaccgaggcttcaggcctgccccggcagctaggtacctctccaggggatggaactctgtgggaactgctatttaattctgatggttaactctgtcagatggccttgatatatgggaataatcgttgcaggagggtaggggaaataagaatcgcaagactctagcacaggacgtgtggattgatggtgaggcctttgctccctctccccttgaaatcctcaaagggcagttcccgatttctatcacctttgaaattcatccctgatgtcttctccatctttgggaagtgcaatgcaatttcaagctcttgaatcttccctctcccacatttgtcaaatatactgacgctacaaactcctttcttacaggaaacctgaaactgccattgagcagaaggaaaacatccctttccagaacctttctcgtttttctaaaaatctgcacttttggaagtgatcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagagggtaagaagacccattttgggctctcacttctcacccactcccaagatggtcacctccagtcttcccccctataccttaccctttcttcagctagccaaaacctgccctggtacttgaggcttcttcagttgccttcttttgcaggcagtagaataaaggaaagagggcagtgtcaatagaagaaaagttacagccactttatctaattgaagatactgtgcagagcctttgaaaaaacaaaatatctcacccaccattcctctctccgtttccaccctagcttcctattttagcaaaaatggtgggatcagcacctctggagggaaggggtcactcttccaggttaggaatgtggacaggagttatggagcttacttccctaaaggaggaggcattctagttccggcattcagattctgtctgattccaatatggtgtttgtgtggggtggtcagagaaagggcaagtcggcaactgtatattcctcagcaagagactataagacatttgcatttggaaaatcaggagagatgctgatatggtttggctccgtgtccccacccaaatctcaccttgaattgtaataatccccatgtgtcaagggtgagaccaggtggagataattgaatcatggggttggttttccccatgctgttctcgtgttagtgagtgggtctcacgagatctgatagttttataattgcctggcattttcccctgctggcacacattctcctgcggccctctgaagaggtgccttccatcacgattgtaagtttcctgaggcctccccagccatgcagagctttgagtcaattaaaacttctttctttat

SEQ ID NO: 277110 - DNA, 2060 bp, Homo sapiens
aagttagaaagaacctgagacgtgacactgaaaatcagtagaagaaatacgccacatttattctaccggggaagacagtgggtaagaaaaaaataccgtaacatttaaattaaaaaataattaaaaatttaaaagcaaatagaaattaaaacaaaatacactgataacctcgctgccagaacaagatacaccaaaaaaaaattttttttttgattatacaaaacatacaaagcatcctacaaacagaaagaaattgcaaacagggtcgaatggtgagatcctaccattatatttgtcagcactaaacccgtgcctcttgcgcctatccgaagtttcctcggattaagaagaaacagccatggttaaaccggtatttgcgacaccaacaattatctgtagccgacgtaccccaacttctacatgagtgaaaaatcgccagcatagccagggcgagactattgcgaattctaacttggtatgatttaaaaattccagacactgctaaatttttttaaattgcattcttcagtacctagattaatacaggagttataaaccgcacgcatggctataatgggggctcctattacggaacaggaatttgctactactaaaattatgtaggcatggttaaagccagaattgttacaaccagaaatcgcaaactggaataactctcaacttgctacggtaagaaataactaaactctgacttggtcagactaagaaatcaggagtttgagaccagcccaggcaacatggcgaaatcctgtctctaggaaggatacaaaaaattacccgggcgtggtggcgcgtgcctgtggtcccagctaccccggaggctggggtgggaggatcgcttcagcccgggaggcggaggttgcagtgagccgagatcgcggcactgcactccagcctgggcgacagagccggaccccgtatcaagaaagaaagagaaaagaaaaagaaccaaagaaaaagaaaagtcaccatcgcacggttaagtctgccttgctacagctaaacagtgacttcctaggaccaagaaatcgcagccagggctagaccgatgccctaaatcgggacttgcttaggctgagaaatcacattttggctagttatttggacaagaggtagaaatagcgggcaccgcgaaatcgaaacttgctaggaccaagaagccaacgacgggcgaaaccgcaggggcctgcgatagagacgccagcggcgccgccgggggactgggttcaggaggccgagcaggaacccgtgcgtcggcgctcgcggcgctgtgaagagacggcgtccgcgcagctcctctgcctctggctcggaggagcggcgggctcccccgcccagcgccggcgtcgcccgggaaccccagactctgcgcaactggctgcgattccaaatccctcagatcggctaccagagcgctgccgccaccgagaaaatggaggcaccgaggaacaagatgtgccgcgaccaagagaactcggcttggcgaaatggcggtgctgggaccctaagagtgacgccagccggaggagttcccaaggacaacatccattttggcggaaccaacggtgttgtcacgcagaaaatgtcgaccctcggaaaagagaggttctgcgaccgagaaattcggtgcaacaagtgctgtgacagaaaaccccccgctcggcgctgctggcgaaagagccaacaaaacgctgggtgctgccaccgtgacaccgactttaggaccccggcctcggatggagaaaggagggtacggagccaccacataacttcctaatgtcttcaaatagcgaaagtgctagccggaaactgccggctgggtttacctattggtgctcgtgtgggactagcagattcgagaaaccagcgggactggaacctagtacacttcggcctctcaaagtgctaggattatagaagtgagccaccacgctcggcaaatgtttcaattttattcacaaaagtatactttacccaattgttgtaaactataaatattaatgtttaaaataaaatttttcttgactcaaaaacaaaac

SEQ ID NO: 277111 - DNA, 176 bp, Homo sapiens
attataggcatgtgtcaccacgctcggccccaaattcagcatttttttaaagcatagtcacagagttgtgtaatcatcaccactatctaattcttgaacattttcatcaccccaagaagaaaccctgtactcatttatattttttaaatagaaatatttggaccaaataatttgcc

SEQ ID NO: 277112 - DNA, 1046 bp, Homo sapiens
agtcacagaagaaataaacactttaaaaagaccgtttggctttaccttctccatcctcttgaattgattttggctgtgacacagtgaaacactgcattacttcataacgctggcaagcttcttggttctcggtccctggctcatctggagggtgaattagcatcctgcagttaaagggacatggggagcccagaaatttaagaagcagaatgagtgccatgaccagatttgtaagctccctaaagacagaaacatgtctcacatttcacttgtatccttaaaacatcatgcaaatggtgctggctgaagagtacgcacttaacatgtacttgagttgaattggaaatattcaacaagcataaacacagctacctatacttttgagattaacgttttaatcctcattctcctagaagaatgaatgaatggagaagaggtaacaggaggaagatatgagatatctcactccaccaaacagttgctgagaaactcctatccaaggatctgtgcacaatgctggcaataccctgatgtctaacagatgctctttatgattaaagaattcaattctgtttggggagacagaaacattacaaggtggcattcatacataaactcagtttcaaaattatacatttttagtttaccatatcaaatacattgttttgttaaagctgaagcccatatttcagttataaacctcaaggagatggtactttcaaatatttttaaagcaaatgtgaatataattatctttaagatatctaaagaagagaaaaaagatatgaaacttttatatttgtaatgatgctatatacacaaaaacatcagagcatctacagataaaccattaaaacacataagaagattcagcacaatggatggatctgaagaataaccaagaacgtcttgtttcatcacatatcaaggcaattatcataagaaagctcagaaccagatccctatatatacaggaacttgacttataataaagagcgatgcggccgtatttacctggggaacaaagggcgagtgatcgagaatag

SEQ ID NO: 277113 - DNA, 816 bp, Homo sapiens
atgaaggggaaaaagatgagagaaagactattcaaaaggtacagaatgtgcaactttatgggttgcatgaactagatataatggccagttcctggattactggggctaggaatcaaatgagtagaggattataaaaatagctgtgtgctgtgctatacgaggataggcagcttatggattatgaaagtagaacacactaaaagtaaaaatcaatccagtaagtgttttggtaagtgggtgaatatgatcaaggaataaagaatgactaggaaaagctaggatgcatgaagaatagcaggcgttcttgtagtaaagggaagtctaacaagcccttctccaacgtggcttcagaggaccctttcctctgccctcaactcacctgggatctgatcctcagtggcaatcacctcagtctgggggaagcaccatgacttccagaatttgaacaaagatgtttgaatcttttaagtccatgaggaggagatgttttacaaagagatgagcattaggaaagggaaaagaaagagagagaagcaggacgttgacaaggactgggtcgcttttctgattcatgtgcatattctttgaggtcaggtccttcttttggctctgcttaaattggttctagatcatattattgtccttaatgaattcttacccaggctggagtgccatggtgtgatcatagttcacagcagccttgaaatcctggtctcaagcgacctgttcccctctcgatgcatcgtgagtagggcgattctagcagtcactgccgtcatgttacactggttactagctatgaccagtagagtacgg

SEQ ID NO: 277114 - DNA, 871 bp, Homo sapiens
ggcggactcccgggcggcggggacgcgcggggacccggccgcgggacgagggaggccggcggctggacactacctgcgggagagcgagtgaggttctggccctccgagttgaccgcctgcaggtgtttacagaacatccacggagtttgggccaagcccagagtgaggagctgggcactggggtggcagaagaccaggccttgccttgagcccttgtgcgagctttacctcaaagcctctgtaatcgaagtgggagaaggggtggtggtgcgtggttggtctcagccacctccaccactcctcagaagatgaacgctggatccaggaagagattgtcaagcctcccaagccctgtggggacagtgcacacagactatgatggatgcctgaagtgggttgcattacaagagaggagcactgagctaaaggaatttgcctcttttaggctacacagaattaagcctgctctttgaaggtggggagatgttatctcatccctcaaacgttgcttgctacaaacaccgcccagagaaatggactgataaagagctggacattggagtggcagaacagcaagaatgatcagagaagttcaagggccatggcagagagccttttccaacatagtacagtgtacttatacactacatatgaaggccagctaatctagtcttgggagaaccaagagaggcttctgaaagagatgacatctatgccgaaccttgaaggtcaaacaggaatcagccacataaagagaaggaggagagcattctggatagcaggaacatcatgtataaaactttgaagtaaacgatacactccgagaagtttttcattccctttcacattcatctccatattgaactccaat

SEQ ID NO: 277115 - DNA, 416 bp, Homo sapiens
tgatggagtctcactctgtcactcaggctggagtgcaatggcacggtctcagctcactgcgacctccgcctcctgggttcatgcctacagagtgcatatcatgcatgtacttaaaactatgggaaggaaatgacacgtaaacacacagaggccaagaaactaagcaacccacctgtcaaccaaaaggcacatgctggctaaagcttaggcagcttgaggaaaaagagaaaaaaaacacatagaaaaggccatgaaatatagcaaagtgatgctgataccattcgcaggtcatccttgatccatagtggatcgtactgtgcttaataaacttttgctgctttgctatttgtgtgtgtcatgtccaattttttgtttgcggcaccaacaacttgggacttcacaacatcagccagtaa

SEQ ID NO: 277116 - DNA, 591 bp, Homo sapiens
gatgcattctcaccatgctgcaaggctgctctcggactcctggcctcaagcaatctgcccaccgcgtcctcccaaagtgctggatggaattacagacaaactgaactgcttccaaatagcctcaattacctggatcccaacagtcaagaattgttgttaaggcacttcggagaaggtcagtccaagcagtacggctcttttctgcccgggccatgggagaagataatattccttttagagcctgtagggaagctgcaactgtcgaagataactggcccccaggtaacttcacagcagtctctctgaggaccccgattgtgaggtacaatatagtagggagaattgagatgcttcctgtaagatacattttttaaaaacacactggatttcaacctatatatatggtttctaaaaagaaatcatcaaggagtaagacaatgtcagattttcagtttttaaaagatgatttctaataaagaattataactgttaagataatgtaagtagctttattaaaatttttatggatggattaaatcttgatggttataactggagattacgtttaaataaattgtgtgagtatcatta

SEQ ID NO: 277117 - DNA, 607 bp, Homo sapiens
actccccatagggatttggcccctcaggcccaagaattcggcaaagggctcgtgagggatccgagggctccgtccttgtgctgtcttcgccccggctcccaggggtcaaacgagggtcgggggtggggacacgcagcctagccactgtcctgcctgggatccggtctcccccgccccccggctgcagggtggataaagaggaagatgtgaagaggaggcagacaaaagcaaaaggacatcctgtcagtaggaaacggccgaattacaattcagatgtgcaatgtttgcataagtaaactgacacgggactattatatgcagaaatccacgtgcaaaaattttcagacacacctttgtacctcttcctaatcctgccctggtaaaatggcggttatcagtgcaagtttgaggatacatacagctggaaaatggacatcaccaaactggactccagaaagttctgtctaggattttattagactgctttttttctcaatatacctgtattggaagattgagacaaaaaggcacaaactcacattaaataaacaaggtaatctaatcaattctacaaagtgtagtttgtaaaacaagtagcactaggaac

SEQ ID NO: 277118 - DNA, 582 bp, Homo sapiens
ccgccgccgcagcctctgccccactcgtgagggatccgagggctccgtccttgtgctgtcttcgccccggctcccaggggtcaaacgagggtcgggggtggggacacgcagcctagccactgtcctgcctgggatccggtctcccccgccccccggctgcagggtggataaagaggaagatgtgaagaggaggcagacaaaagcaaaaggacatcctgtcagtaggaaacggccgaattacaattcagatgtgcaatgtttgcataagtaaactgacacgggactattatatgcagaaatccacgtgcaaaaattttcagacacacctttgtacctcttcctaatcctgccctggtaaaatggcggttatcagtgcaagtttgaggatacatacagctggaaaatggacatcaccaaactggactccagaaagttctgtctaggattttattagactgctttttttctcaatatacctgtattggaagattgagacaaaaaggcacaaactcacattaaataaacaaggtaatctaatcaattctacaaagtgtagtttgtaaaacaagtagcactaggaac

SEQ ID NO: 277119 - DNA, 351 bp, Homo sapiens
cggcacgaggtggagcggccacaaatgtttgcataagtaaactgacacgggactattatatgcagaaatccacgtgcaaaaattttcagacacacctttgtacctcttcctaatcctgccctggtaaaatggcggttatcagtgcaagtttgaggatacatacagctggaaaatggacatcaccaaactggactccagaaagttctgtctaggattttattagactgctttttttctcaatatacctgtattggaagattgagacaaaaaggcacaaactcacattaaataaacaaggtaatctaatcaattctacaaagtgtagtttgtaaaacaagtagcactaggaac

SEQ ID NO: 277120 - DNA, 407 bp, Homo sapiens
ctactttaaataaatgttttgcttgtttggtagggtggataaagaggaagatgtgaagaggaggcagacaaaagcaaaaggacatcctgtcagtaggaaacggccgaattacaattcagatgtgcaatgtttgcataagtaaactgacacgggactattatatgcagaaatccacgtgcaaaaattttcagacacacctttgtacctcttcctaatcctgccctggtaaaatggcggttatcagtgcaagtttgaggatacatacagctggaaaatggacatcaccaaactggactccagaaagttctgtctaggattttattagactgctttttttctcaatatacctgtattggaagattgagacaaaaaggcacaaactcacattaaataaacaaggtaatcta

SEQ ID NO: 277121 - DNA, 331 bp, Homo sapiens
ctgaacgcggctttctggtgagagaactggaccctcggaaaccctccgagtcccgaattcgttggttcctctagggctctacttctcgcctgccctgttttcttcgctgcactggctccttcctgtacttgcctaattttgcctcacctccttccactccatcccgcctgcaggcttcggcaccctagttcttcccagggccgtccacccatcttctctgccttacctgtgcccgcacccccgccccgcacatctggcgggagcttctggtaacatcttgagccgctcaagagtgagcgagggctcctcttttgagcccgacaaagctgcg

SEQ ID NO: 277122 - DNA, 552 bp, Homo sapiens
tgaagtctgttttttggctgaccccactacacatgatagcttggcagtgttttgttaagcttactatagttcattttgaccagaggaagataacacaaaggtttaaaagaaaatgcagcggagaaacggttcatctttccaagaaaccctagtgttctgagtcacatcatgagtaaatggtggacggaaggcaggtttagctgggcagtcatcaaaaatcatgaagggcaagcaagccaggtaccacaccctcaggcactccccaaactcgttgcccatcggataaagttagtccaagtgccaactcctgccacaacaatgccttataaggactcttaaatcctgtctgacctttgaacaggttcagagtgtgctgtgttcaaatgggaaggaatataaagtaattctagaagatatccaaccggttgataaattgtagaccctaaagggggaaaaagacatcttttgtctggaatttactttgaggggatgtgatttttgagggtaagattttcagtaggtaataaagtaaaatcccgtacctcaactaat

SEQ ID NO: 277123 - DNA, 3616 bp, Homo sapiens
  misc_feature (1332)..(1332): n is a, c, g, or t
  misc_feature (2401)..(2401): n is a, c, g, or t
atgtagtaattttgcctggatggttttggatataatagccaattcatcacttgtgatttgatgactcttagggtctctagtttttcttaacagcctccaaattgaagtttcagaatccttactgcaaaaagcacaaaagttttcattgccattttgatagtgatatgtagctcgtaaataataattcttacctctgtgttagataaaacatccagtaaaacagcatcaagtttagctttgatagaagggaacaattagagttggtgtagagacagaccagttaggatgagggcatgaaatacagcagaagcagtaggaagagaagagagactgaggatcttgaattagggtctagatgaaaatttaggatgattcctaggtttgggaatggagggagagcttaaacaagatagagaatatagacacagattttggaggaaatgattttctcaagggactgctgagtccaaggaatgtttacaaatcctcaagaagtactccaggctatttgtaagatctgaggctcataggccttttctggctctcaggatttagagtcgtaataggcagtaatgtaaattcactagctaactttgaggttgcaacattcatagcactctgaactttgagggcatcttgttttaattcaaaaaactggtaatccctgcttttgattgtgatgtaagtagcagtacacaagcatgggaataagtaaatccaataaaggagtatttaggctcacctgctaaatactcagtgtgccacccaaaccatctgtaatgggtccccttattgaaaacattctttttccagaatgggcaaggaaggctggatgggcaaaagcaaaataaatgtaccacagacccttgattctgttagtatcagtgataaaacatgattgataaaactaggcatgatacattcttaaggtacagaaaaatgtggaaattgtgtcaagaaaattcacaaattttaaatggttctttaggctgatagtaataaatgggatcattataattttatgtaaaaccttcaaaggcttcctactaaagaaagctgaattccagtaacagattgagcccagactactcagttcatatttgaggccaacttagactatttttgatgccttaaagattccttcaagtcccctttctctttctaccatacccccagtaaagctacttaaaatcctctgtaggaaagagctgagtaattgggggcagagatggaggacaaatttaagggaacagaaagccattgggaagacaaatgaaagccagaatctgaagataattttaaaaccttcagggaaagtaggtgtctaatcanaggacttaattcacttgagtagaaatttgtaatttagccataggaatttaggaagtgttagttacaagaggtaacttgaagctgtggacatgatgatagcttttgttgcataattagaatgtgccaaacactttgctaagtgcttatgatagcttttctcttcagaacatcaccatgattatttacagtataacctgtattttacagatggagaaatgtaggcaaaggaaaggggcataacttgcctccagggtcacatagatagcaaatgatgaaatttaattttaaaattagaaactgattccaaagtccttacactcttaaccatgaaactgaagacatctaagtcaccacgcaaaacccagaatctaaatggccatttattagtgcttattcctttatttcctaatattaattaaatgacttaattaccatgagaagataatgtgctttcagttttcgcagtagttagttcagccattgattttcttactaagaacctctaaaaggccaatgggcagttgacaaaaattagggatggattctgcagctgtaagaccaagtgaaagtaaaaggcccatggcggtaaatttgtcccttgcaggcagtttgttctaaatgcttgtgcctagaaataaacttagccttattatcatctggactctgagcaatttttgcatctcagtattcttagatgtggatgattaaaaggccacgtatgaaggcagctaacataagacactttgtgggagtgagataattcattaaaatcaaatattagtgtattaggcaaacaaattcaatcatttcagttatgtaaagctagctgggttctcagttttagcaagttagggaagatatcacattacaggagaaagacaatctaaaagtttttgaagttttaatggatttaaccacttgtaaaatgttataaattgtaggacacttctcccagagagatcctctagcatacatggatgatttacttttcatatttatgatttggcaggaaagtttgagttcatttgaagttaggctttttaatagtttttctcctcccagtgaattnttctgagttgataggtgtaaaatttatagattttattgataataaaagtttgtaagcatctttaatgtagcgattccattgcttattttttattcagcactcaggtcacttcctatgtgctggagataattaaagactccacttccaagaaaggatacaacaaggaaaataagaggttgttaaataaaaattatgccaaagataagcctgtagaaagcttctgtggtgcgtatttggtagattttatggatggatttcgtgaaggataaatagcagagtcctgaggggggaaaaaaggatagaagtggccaaatacaagagaggaaatgggagaaagaataggatatgaagaagcctggcattgagaggtggtattggcctgttaagaaaacttgtttgcctagcccctaagttctagtctcactcagtattgggtttagggctcctctagattctagtacatcatgatagatcatgcagtcagtaaaagtcctgctgattttccccagtaaagtgctttagtccacacaaagcctgatctttaatccatgcctagaattggcaaatgatgccaggaaagaaaacagttggtagtctcagctatgtagaaaagacaaagacttttagtacatctagtcttaagcgcttccacagctctttcgtatctgtaatgtattttgcatttgatccattttttcctagttactgcacctgggagcgactgccagtactaccacatcatttcggtagtggaggtccccattgaagggtttttttcatagcacatagcatgatcacgtctaggaagatcgttctggctgtagatagtataattatctactaatacaaagggggaaaggacgtgagatgatgtgaaaggaagttttgcatcatttacttgaaagatactgttcttctgaatttaatcacattggggattggaaaaagtagatgaataaaaattaaaaagaaaaaaacaaatgagttcatgaagttaagcaattaaagaaaaagacaaatctaatacagtactgtaattatttcaaaggttactattttaccctaaactcatttctatacttgaaagttcaaggatcgattgatatttttgaaattctgaactaaatggaaatattaagatggctcatgtgtgcatatataaatgttatttgtatcctcagaataaactaataaatttcaagggtacaaaatagg

SEQ ID NO: 277124 - DNA, 921 bp, Homo sapiens
ctggggtggggttagcgatgagtcagctaccagggtgagcccacttgaaaccacttgggagaacctgccagtgtcaggatcctatacctccagccttgaactgccaggtggggccagggactcaagagccctcatgccccagcagcttccaagtggtcatcatggaggcagccgattacagcagaaaggcattcttccttccctgccttcctcactgccccacctggggcaacaatccttactatatctgctcagacctgcccctctgccctggcctaacacatgcatacccttcccagccgagggcctggcacccagtgcattgggagctgatgtttctagggctgcaagtcagcacctcccctccttcccccagtgaccccagagcttaccttgcagttacaacccaggtgataccgatagttcagccccttgcgctgggagagggtgagctggtcccacctctccacgaagttgcacagccccgtgtacatcttgccatcatagacgcgacctacaggaggaaagaagaaaacaaggagaggttgttttgtccagagcctagcccagagagaattcacacctactatgttcccacttagcccaggcactgtggctgggtacttttcagacccatgattttatttcaccctacccaacaccttttaaaatggactgtagccccattttccagatgaggataatgaggcttggagaggtaaagtgatttgccaaaggtcccaagcccattaaatactggagctaggactagaggccaactcttcactccctttataatgatttttgtttttgttttctcctttactacactgactgcctaaagatgaataactttcaaagacgggcctaacaggtcgagtgtgaggtggagaggaacagatactccctttttatttacag

SEQ ID NO: 277125 - DNA, 874 bp, Homo sapiens
cgccgtgggacggcgtcgctccccgccggctgccgttagggctgggagccggctgggcgcgggggtagtgagggtgcctctcgccgtggctgcgcggcggcctcgtccgagaggccggcgccggggcagtgaccggcccgtgcccagccgccgcgcagggcgcccggggcagctggccgagccctcgatgcctcccgtctgacggaggcgcccgggaagcgccgcccacctcggccccgcaccctcgccggcctgccgggtctccgccagccctagcagacagagaggggcgccggtccctagtcccccagacctccattcaaggtcaaaactttgcccagctcagccttgctcgaccctgggcagggaagcgcggacatcggcagagggagcccgaggctctccgtgcccttcgcgccgctccccaaggatggataacactaacatatagtcagtgggaaagaaatctcagaaaataactgttagtttgtcactgtcatgggaaatgggaaggaagaaaaacagcacttatcaagcatcttctgtgtacaaactgccatttcagactcagagcagtccttgaaggtcaagaactgtggaatctttcagatgatattctgatacttctggaccaagattgaatttgttcttcatgaaaaatgtctgggaccttttatatggacggggaataccaacgtagagatggtcaagaaaatttgcgctccgacctaaaccaagcacgttgtatggtagttggagagctaaatgtgcggattggctgagttggccagctagagttattcaattaaaaaaaaattaaaaacatctctggaaacattgctcccatcaaatattaaaatgataaaatgttaaa

SEQ ID NO: 277126 - DNA, 973 bp, Homo sapiens
cgccgtgggacggcgtcgctccccgccggctgccgttagggctgggagccggctgggcgcgggggtagtgagggtgcctctcgccgtggctgcgcggcggcctcgtccgagaggccggcgccggggcagtgaccggcccgtgcccagccgccgcgcagggcgcccggggcagctggccgagccctcgatgcctcccgtctgacggaggcgcccgggaagcgccgcccacctcggccccgcaccctcgccggcctgccgggtctccgccagccctagcagacagagaggggcgccggtccctagtcccccagacctccattcaaggtcaaaactttgcccagctcagccttgctcgaccctgggcagggaagcgcggacatcggcagagggagcccgaggctctccgtgcccttcgcgccggtcaagaactgtggaatctttcagatgatattctgatacttctggaccaagattgaatttgttcttcatgaaaaatgtctgggaccttttatatggacggggaataccaacgtagagatggtcaagaaaatttgcgctccgacctaaaccaagcacgttgtatggtagttggagagctaaatgtgggaggagccaagatggccgaataggaaaagctccggtctacagctcccagcgtgagcaacgcagaagacgggtgatttctgcatttccatctgagggtgtactccatctacttttaaaaacaaaaagttcactgtaaaacagcctcaggtaggccgttcagtaggtattccagaagaaggtattgtcatcataggagatggacagctccaagggtgtttattgcccctgaagactttctagtggaacaagatgtggaggtggaagacactgatgttggtgatcctgactcagtgcaggcctaagctaatgtgggtgtttgtgtcttagtttttaactaaaggtttaaaaagtaaaaataaaacattaa

SEQ ID NO: 277127 - DNA, 709 bp, Homo sapiens
cgccgtgggacggcgtcgctccccgccggctgccgttagggctgggagccggctgggcgcgggggtagtgagggtgcctctcgccgtggctgcgcggcggcctcgtccgagaggccggcgccggggcagtgaccggcccgtgcccagccgccgcgcagggcgcccggggcagctggccgagccctcgatgcctcccgtctgacggaggcgcccgggaagcgccgcccacctcggccccgcaccctcgccggcctgccgggtctccgccagccctagcagacagagaggggcgccggtccctagtcccccagacctccattcaaggtcaaaactttgcccagctcagccttgctcgaccctgggcagggaagcgcggacatcggcagagggagcccgaggctctccgtgcccttcgcgccggtcaagaactgtggaatctttcagatgatattctgatacttctggaccaagattgaatttgttcttcatgaaaaatgtctgggaccttttatatggacggggaataccaacgtagagatggtcaagaaaatttgcgctccgacctaaaccaagcacgttgtatggtagttggagagctaaatgtgcggattggctgagttggccagctagagttattcaattaaaaaaaaattaaaaacatctctggaaacattgctcccatcaaatattaaaatgataaaatgttaaa

SEQ ID NO: 277128 - DNA, 260 bp, Homo sapiens
aggagaatcacctgaactggggaggaggaggttgcagtgagccaagattgtgctactgtactccagcctgggcaacagagcaagaccctgtctcaaaataataaataaactagtaacagtgagaatggagaaaagatttagagactgtttataaaacagttaggactttggatctggagaactaagaataagaagtaatggatgatgtggtttttctagtttggaagaccaggtagaccataatgtcatcaatggaatta

SEQ ID NO: 277129 - DNA, 529 bp, Homo sapiens
  misc_feature (455)..(455): n is a, c, g, or t
  misc_feature (505)..(505): n is a, c, g, or t
  misc_feature (527)..(527): n is a, c, g, or t
caggcacttacctgtaattctccccagccatccatcgtacatctctccaacaaacccagatatgtgggctcctagacttactccgatcatgtaaatgtcatcaagagaagctccttctgccaacatctggtcaataaattccttcaagaccatggctggggagaattacaggcctcggaccccctgcaggccctttattcaacgggaaacctcaccaagacagattagatcccagtgatgcgcagtttgttgatgtcatccattccgacactgatgcactgggctacaaggagccattaggaaacatagacttctacccaaatggaggattggatcaacctggctgccccaaaacaatattgggaggatttcagtattttaaatgtgaccaccagaggtctgtatacctgtacctgtcttccctgagagagagctgcaccatcactgcgtatccntgtgactcctaccaggattattaggaatggcaagtgtgtcagcttgcggnacgtcacaaaaagagtcctgtncc

SEQ ID NO: 277130 - DNA, 1812 bp, Homo sapiens
gggcactaataatatgtgcaatcaaatttattaatcagtagaaaaacaacatgtattcaatttaatgttaatccacaaatagctcttggtcagatttatgaaagtctgtgtaagttagaacacaattttacatttttttctctaagcaatatgcaaaagataacaatatttaactacaaatatataaacaattttagtattatactaaggattgtacttgaagaagttacaatgtaatggaaataataacttaccatattacaggtctcaacactatcatgttggcccctattcagagactgtgcagcgtacacaattagtgcagcagcagttcttggtataatatatgacaaccaagtttactggtaagcttgaaaataattcttatgtaaaaattagagattttatgaatttctgatggttcagtaattttttttcagaaatgttatttcagtcacttaatctgccacttctataccatattccaacaggtctgtgagttaacctcatcacaattgctgattgagttcttctcactagtttgcaatttcttcttaatcacttcacagtctccttttttctctcactagtcactggagaccaccacttttccttctccccactggctgcctattcagaaagtttcccaactcctgttgtccattaaagccacaacagttgactttttcttctgctgggttactgctcaccttgccttggttagaagtgttcatggccacaaaagactggagaaggatggtagaggaagtaaaagaagtctttttaaattcctccaaacttctgatgctcattcaggagaaactatagccttcctctaagaaataacaatgcttagcttttcatattaaaaattgtttgctttccttacaatctctctgtgcctagctggtccaagaaaatgaaaaaggtggtgactgagtggacagatactaactttttcaactagtaagcagcaggcacctactaggtccttctcactatgctagatatcataagggataatgaaatgtaaaacacagctacacaggttatatacattgcataactccagaggacaccagaaaaatatgaaaaaaaaaaaatgtaatggtgtccatctggagaaccataaccttgcagcacggcgtaatacctgctatcaagaaacttaaaacctagccagaagcataatttctaaactaatcatcctgtcctctagtccgtctccctaagacactgtgttggtagaatagaaatccttctagaactcagcagttgtctgtaagggatagtgactgtgagagtatccaagctaattcttcctccattagggaaatcagaactgttctttaagatacagcagacagagattcactggctataaaaggtaaatgcaaggttcaaatgtgatggcattagctaactgccagagtacagggaaacagttcttggttccaagggtataattttatattttagaacatcttgttttcttgtgactgtaagccaaattcagctacattcaaatcattaaaaatgctctgtatgacaaactgaaaaatcccagcctaagcctcccatatctgagtaatattttacacaaagttcctataccagaaaacttggacagttgaaataacttaacagttactatattattttataattattatgtatgttggggaatgtattatgccaatgagctgaggcagaaaatgttcaccactatttattaattttacatttattttgaaaatctccaattatcattttcattgcatttttatacctatcatttggaaggaatctaca

SEQ ID NO: 277131 - DNA, 1424 bp, Homo sapiens
tgttgatcttgtttttaaaaaaaaaaaaacaacacagaagtgtccagcttttatcaataaacataataatgctgtaatcaagtctggacaaatctacaaaacaaaaaatatctagaaatgtttgattgttctatggctacttttgttagaaaatcattcaatagatactgcccaaaagctatcaactctaaaatgactttcacttttaatttaaaaacacaaatttctcttttgtaggtatgaaggggctttactgcttttgatatatggattgtatgttttggtgctgtgtttgacattaaaattaaccaatatattataaagaaatgcagtccttgctgcgcctgtcttgccaaagctatggagagaagtgaacaacagccactgatgggctgggaagatgaaggtcaaccattcattcgtcggcaatcaagaactgatagtggaatattttatgaagattctggctactctcagctctctataagtttacatggccttagtcaggtttctgaagatccaccaagtgttttcaacatgcctgaagcagacttaaaaagaattttttgggtattatcccttcctattattacattactttttctaaccacaccagattgtagaaaaaagttttggaaaaactactttgtgataacctttttcatgtctgcaatatggatatccgcatttacatatatcctggtttggatggtcacaataactggggaaacactagaaattcccgatacagtaatgggccttactttattagcagcaggaacaagcataccagacacaattgcaagtgtgttggttgcaagaaaagggaaaggagatatggctatgtctaacatcgtgggatccaatgtgtttgatatgttgtgccttggtattccatggtttattaaaactgcatttataaatggatcagctcctgcagaagtaaacagcagaggactaacttacataaccatctctctcaacatttcaattatttttctttttttagcagttcacttcaatggctggaaactagacagaaagttgggaatagtctgcctattatcatacttggggcttgctacattatcagttctatatgaacttggaattattggaaataatacaaataaggggctgtggaggttgatattattaatagtgttatgcagaaaatatgaatggcagggaggggcagagagaaaaatccatttcttcatttaaatcaaattttaaaaatcttgaaccttagaatctaaaacttacagtaatttaaaaccaaccaaaatcacatcctaatttttctgagccctttcttttcatgaaaaattacatattataaaacagaagtttggggggaaaaaatctatgttttaccatacaataagttgacaaaaactggagaaactagaacaaacaaatcc

SEQ ID NO: 277132 - DNA, 1390 bp, Homo sapiens
gatatgcgacttaataaaaaaattatgctatgattattttatattctttaagtatacattatctggtacatagggcaggcagaggcatcatcaatattatgaagtggagacaactggagtagctaggttagaaaccaggttaatcccttaagcaaaaagttactgaagacaatccacaggagatgtccaattgacacttcataaacactatctacaatatatttaacgaatggcccaagacatttttatagatttaaggccccaaataaagaaatgcggagtatcacatcttacattgtctgccctaaagtttcaattagtttcttttcaccagcaatatcagtaatgaggtactcaaatgttttaaacagccttttaaaaactgatacagctaatttatttcaatataactttctaaataggcatttctaacttaattagccatttgagaaaactcaaaagtgtttactttttccacaacagatccaccaagtgttttcaacatgcctgaagcagacttaaaaagaattttttgggtattatcccttcctattattacattactttttctaaccacaccagattgtagaaaaaagttttggaaaaactactttgtgataacctttttcatgtctgcaatatggatatccgcatttacatatatcctggtttggatggtcacaataactggggaaacactagaaattcccgatacagtaatgggccttactttattagcagcaggaacaagcataccagacacaattgcaagtgtgttggttgcaagaaaagggaaaggagatatggctatgtctaacatcgtgggatccaatgtgtttgatatgttgtgccttggtattccatggtttattaaaactgcatttataaatggatcagctcctgcagaagtaaacagcagaggactaacttacataaccatctctctcaacatttcaattatttttctttttttagcagttcacttcaatggctggaaactagacagaaagttgggaatagtctgcctattatcatacttggggcttgctacattatcagttctatatgaacttggaattattggaaataatacaaataaggggctgtggaggttgatattattaatagtgttatgcagaaaatatgaatggcagggaggggcagagagaaaaatccatttcttcatttaaatcaaattttaaaaatcttgaaccttagaatctaaaacttacagtaatttaaaaccaaccaaaatcacatcctaatttttctgagccctttcttttcatgaaaaattacatattataaaacagaagtttggggggaaaaaatctatgttttaccatacaataagttgacaaaaactggagaaactagaacaaacaaatcc

SEQ ID NO: 277133 - DNA, 1762 bp, Homo sapiens
ggccaaacatgggcgagaagggctctgttgctcggcatcctgtgggccactgcacatctgcctctctcagggacctccctgccccaacgtctcccaagggccacaggaaatagcacccaatgtgttatttctccatcatcggagtttcccgaagggtttttcacgagacaggagcgcagagatggaggcatcataatctatttcctaattatcgtttacatgttcatggccatatctattgtctgtgatgaatacttcctaccctccctggaaatcatcagtgaatcccttggattgtctcaggatgttgcaggcacaactttcatggcagcgggcagttcagctcctgaattagttactgctttcctaggtgtatttatcacaaagggagatattggcattagcaccatccttggatctgcaatttataatctccttggcatctgtgctgcctgtggtttgctatctaatacggtctcaacactatcatgttggcccctattcagagactgtgcagcgtacacaattagtgcagcagcagttcttggtataatatatgacaaccaagtttactggtatgaaggggctttactgcttttgatatatggattgtatgttttggtgctgtgtttgacattaaaattaaccaatatattataaagaaatgcagtccttgctgcgcctgtcttgccaaagctatggagagaagtgaacaacagccactgatgggctgggaagatgaaggtcaaccattcattcgtcggcaatcaagaactgatagtggaatattttatgaagattctggctactctcagctctctataagtttacatggccttagtcaggtttctgaagatccaccaagtgttttcaacatgcctgaagcagacttaaaaagaattttttgggtattatcccttcctattattacattactttttctaaccacaccagattgtagaaaaaagttttggaaaaactactttgtgataacctttttcatgtctgcaatatggatatccgcatttacatatatcctggtttggatggtcacaataactggggaaacactagaaattcccgatacagtaatgggccttactttattagcagcaggaacaagcataccagacacaattgcaagtgtgttggttgcaagaaaagggaaaggagatatggctatgtctaacatcgtgggatccaatgtgtttgatatgttgtgccttggtattccatggtttattaaaactgcatttataaatggatcagctcctgcagaagtaaacagcagaggactaacttacataaccatctctctcaacatttcaattatttttctttttttagcagttcacttcaatggctggaaactagacagaaagttgggaatagtctgcctattatcatacttggggcttgctacattatcagttctatatgaacttggaattattggaaataatacaaataaggggctgtggaggttgatattattaatagtgttatgcagaaaatatgaatggcagggaggggcagagagaaaaatccatttcttcatttaaatcaaattttaaaaatcttgaaccttagaatctaaaacttacagtaatttaaaaccaaccaaaatcacatcctaatttttctgagccctttcttttcatgaaaaattacatattataaaacagaagtttggggggaaaaaatctatgttttaccatacaataagttgacaaaaactggagaaactagaacaaacaaatcc

SEQ ID NO: 277134 - DNA, 469 bp, Homo sapiens
ttcagtgtgtcagaatctagctatcaagttgaaataggttaatctgatcttatcaccagcagacgcatctcagtcatctggaagaaagtgctgttacaagaagtaactctgggtatgcgcttcaggaatgcagttgtggaaaccatgtttgcggctgctttaaactgtttcccaggagtcaaggaaaattcaacaatctgagaccaaaaaggtatcttcggcacagtcttccttggcacagccgtggagaacagagccagggctttgagtcagaggaattgggttgaaacctgcctgtattggttgcaacctggtgaccttggatatcctttttattctctgagccttatataccccctggataaaatatatctgatgaaacctgctgttgcatgttctgggatttaaatgaataacaccgtacctaaagcatttggtgcagggttaggacgtgtagaagcttaagttg

SEQ ID NO: 277135 - DNA, 624 bp, Homo sapiens
atcctttctacacattttttataaaatcctagaataggaaggagatgtagagaacatttgttcaaatctactgcttgacaaaggcacttctgaattcaagttggtgttccagtaaggttgcctgggcacaccaccctcacatcattgcagaacgcactaaactagagcctgccgtcgtttgggccaacccaacggaattgctctcccttgtaatcataaggacctaaaactgaacagcagacgcatctcagtcatctggaagaaagtgctgttacaagaagtaactctgggtatgcgcttcaggaatgcagttgtggaaaccatgtttgcggctgctttaaactgtttcccaggagtcaaggaaaattcaacaatctgagaccaaaaaggtatcttcggcacagtcttccttggcacagccgtggagaacagagccagggctttgagtcagaggaattgggttgaaacctgcctgtattggttgcaacctggtgaccttggtccggtgaggctccccgagcatgggactttttagctccgtctgacgactgatccctgcagttaactgatcattctacaaagccaccatttgctgaatccattgccaaagaatcgatacaggtg

SEQ ID NO: 277136 - DNA, 3041 bp, Homo sapiens
  misc_feature (2450)..(2450): n is a, c, g, or t
ccactttgtcaaatgttcttttggagaaatcctgagaagaaagtttatttggtggttcaggatttgagtgttgctccttatttatcacagttctcatcagcctttgagacccatcttcctttagtggctcttctggtcttttcttcataagtttggctgatgctgttacagatgctagcacttaagaaaacaagactttaaaaaattatgaaatacaggccgggcgcagtggctcatgcctgtaatcctagcattttgggaggccgaggcgggcggatcatgaggtcaggagatcgagaccatcctggctaacacggtgaaaccctgtctctactaaaaatacaaaaaaaaaaaaaaaaaaaattagctgggcgtggtggcgggcgcctgtaggcccagctactcgcgaggctgaggcaggagaatggtgtgaactcgggatgcggagcttgcagtgagctgagatcgcgccactgccctccagcctgggagatagcgaggctctgtctcaaaaaaaaaaaaaaaaaattatgaaatacaacagacattaagagagtgtacaaatataatattgtattataaataatgataaatgatttccccgtgtaaccactgcccaagtgaaaaaatagaacaatggtaaggtattggcagtttctgagggacgtgatgcgaatgttgtcatcagggtgggtgaggatgtactaggcactgtgctaagcattttacatatactatcttattcaagttttacagaagtctaccataaatactattaccaccccattttgtagttaagaaaactaatgataagagaggtcaggtgagtagctggtagttacatagccagtgagtggctaagcaagaattcaaatagaggctttctgaactccagggcccacacttaatctttattctgcattcctcccagggagccttcatgtgcacagcatggcactgactgcagaagtgtgcctagtattgccatagtcaaagggcacatcatgcactcagcttagaaaaagggacagttcccaaagagggggaaaaaaaaaaaaaaaaaagggacagttccttaaaaaaaaaatactttgtccccaacattccttataaaagtcaatttaatgaatttctcagactattattttagatccatcactcagtaacccttgtccatctatatccgtactcctcttcccacctccagctccagatttcctgaacttttgtttctgctgcctgttcttgtcagaaactgtgcaaccttggttctgtgggtatgtgaatgtcaggttggcagggtgcagctgtgtggttccagatgaccagaagccacaagcggttgctgcttctctcttgggattggttggggagtgaagggcagaccgacggatgccttggttgtttttgtgtgtgggtatcatggggcttcaaactgttgtgctctttgttggctggttgattttgtagctcatgctcttgaggtgctctttcaggtctctccctgttttcctctgaattccactgttttgttatctcttgttagcatacaactgaccttgtttttgaagctgtggagagtagctggtggaaatacctcttccagttgggaaaaaatggacttaaaatgtcccatgtccaggctgacctggatgatgacagttggttgatgagttaatttgaacatgagcagaaatgaggtcacttgcctgcctgactccatgtggccatgctggctccaggttgcaaagttctttgagcaagtaccttgtcttgcctaatctcgaatgtctgttctttttatttcttatctcaaataggcattgtgataacattataggtgcaaaagtatgaggtctaaaggcctctgcttccctgtactccctcagtttgtcctgagcagagggagccccaagccagatggattggatggagaacagcccataggcagtttgcagttgtgggcgcgtagctgggagcatgctcagaaactgattcttggcctcacgcctataatcccagcactttgggaggccgaggcgggtggatcacgagatcaggagatcaagaccatcctggctaacatggtgaaaccccgtctctactaaaaacacaaaaaatcagctgggcgtggtcgcgggtgcctgtagccccagctactcaggaggctgaggcaggagaatggcgtgaacccgggaggcagagcttacagtgagccgagatcgcgccactgcactccagcctgggtgacagagcaaaactccgtctcaaaaaaaagaaactctgattcttgcacctctacgctactgctttggagaaaagcaagcagctgcttgtcaggactaaacttgtaacatgcaggcctacctccattaccctgacattcattggttggcttctgtttgagagggcacagtatctttgtatgccatgattgttttcatataacntaataacctgctgctgacttttctcaacatgtcctttctgcttatgatgttctttctccaggctgctttgggttctcttgtaaggcccgtacagcagctgtcactgagatactgcctcatgacaaacctagaactggctagtgaaaagagcttctcaagagttaatatgagctggacacagtggcttgggcctgtaaccccagctactctggaggctgaggcgggaggatcacttgaggccaggagttcaagactggcctgggcaacatagcaagatcccatctctaaaagcttttttaaaaaaattagctgggccgggcgtggtggctcacacctgtaatcccagcactttgggaggccgaggcgggtggatcacaaggtcaagagatctagaccatcctggccaacatgctgaaaccccgtctctactaaaagtacaaaaattagctgggcgtggtggcgcacacctgtagtcccagctactcgggaggctgagggaggagaattgcttgaatccacaaggcagaggttgcagtgagccgagatggcgccactacactccagcctggcaatagagcgagactccgtctc

SEQ ID NO: 277137 - DNA, 1466 bp, Homo sapiens
cttgtaagacagaaaagttctccaagtccccactcgacccaggaagtccagctggcttcgcctctcactggaattacagttacagaggctgagaagtccaagatcaagggaccacatccagtgagagccttcttgctgatggtggattggaaacagtgtcagcatgactctcccacttggaaagacaaaatgggcttaattattagataaggatacgtttccaactgaaggtggcaacgttatgctggaagaacatgtcaggaagaccacaaaatttcatgactgtacttgctacactttcagcagaagagttatacatattttcaattcaacaaagattaagccaaaaagaattcttagaacattcccactcttctttggcacatcaaaaggcaacaaatgtcattttctcccatgtttttatgtgcagtttagaacaaagaccaattatctatgcagctgtccacagtggataaaacaaaaagcatacatttggtccagagttaagtcacctgggttgggcccatccaaggaagtttgatgtttctactctcatgaaaagtaccaatggcactgcacagtgattatcttagatattaaggataaacacaaatttctccttaaatttccatttattggaaatgattggagggagggaacttctccctcacctccacactgcctcttttccaactcttcttccaacacaaaatagtttaaacagcaagcacttagagagcttttagccttgcttgttgattacaaggcccaagttagtgtatggtttgcccatcggaggaaagctaaaacatgggccttcatgggtattaaaattgaagaaaccttttccagcattttttctattttctttaaagtaacaacctatggacttccccatctgacattttcgagtgatcccactgtgtgaatgaaggactacttcagggtttgagggcaaagctgaaatcttagcaacttaccagtgagcaaaggtagaacccagagcccatctctccttttccaggctgctgagtaaagtctggctcaatcaacctatcaatgaagcagtgcttacaacattctccaagaccacccaaaacccaaactggaaatgaatcatgactaatctgactcattttggctcacacagtgcccttccaatttgtatttacctttaccacccaggacctgaccttggacatgtgtaccaggatgtaaggcaataaacctattcacaattccaaaagggcctggtcctctatgaagatttcctgaaggctacttactttctctactcattaaaatttttgcttaacttcaaatttctgaaatataccatatgtgaaaaatttaaatgttaatctgtgcctactgtactacttgaacagagaaaattaactgataaactgtaaatacaaaatgtcaaaattaattcttctgagttttaatatcatctaaataaaaag

SEQ ID NO: 277138 - DNA, 1407 bp, Homo sapiens
cttgtaagacagaaaagttctccaagtccccactcgacccaggaagtccagctggcttcgcctctcactggaattacagatggtggattggaaacagtgtcagcatgactctcccacttggaaagacaaaatgggcttaattattagataaggatacgtttccaactgaaggtggcaacgttatgctggaagaacatgtcaggaagaccacaaaatttcatgactgtacttgctacactttcagcagaagagttatacatattttcaattcaacaaagattaagccaaaaagaattcttagaacattcccactcttctttggcacatcaaaaggcaacaaatgtcattttctcccatgtttttatgtgcagtttagaacaaagaccaattatctatgcagctgtccacagtggataaaacaaaaagcatacatttggtccagagttaagtcacctgggttgggcccatccaaggaagtttgatgtttctactctcatgaaaagtaccaatggcactgcacagtgattatcttagatattaaggataaacacaaatttctccttaaatttccatttattggaaatgattggagggagggaacttctccctcacctccacactgcctcttttccaactcttcttccaacacaaaatagtttaaacagcaagcacttagagagcttttagccttgcttgttgattacaaggcccaagttagtgtatggtttgcccatcggaggaaagctaaaacatgggccttcatgggtattaaaattgaagaaaccttttccagcattttttctattttctttaaagtaacaacctatggacttccccatctgacattttcgagtgatcccactgtgtgaatgaaggactacttcagggtttgagggcaaagctgaaatcttagcaacttaccagtgagcaaaggtagaacccagagcccatctctccttttccaggctgctgagtaaagtctggctcaatcaacctatcaatgaagcagtgcttacaacattctccaagaccacccaaaacccaaactggaaatgaatcatgactaatctgactcattttggctcacacagtgcccttccaatttgtatttacctttaccacccaggacctgaccttggacatgtgtaccaggatgtaaggcaataaacctattcacaattccaaaagggcctggtcctctatgaagatttcctgaaggctacttactttctctactcattaaaatttttgcttaacttcaaatttctgaaatataccatatgtgaaaaatttaaatgttaatctgtgcctactgtactacttgaacagagaaaattaactgataaactgtaaatacaaaatgtcaaaattaattcttctgagttttaatatcatctaaataaaaag

SEQ ID NO: 277139 - DNA, 636 bp, Homo sapiens
attttaaatatatttcaaagaaaagagttcacatttaaataaagtaataaatgattacaagtagggtttattacaggcatgcatggctgtttcaatatttgttttgtttttcttcccaagatggtggattggaaacagtgtcagcatgactctcccacttggaaagacaaaatggtgagtagaaattcatactgtgaacttttttctaagaagcaatgcaggaactgaacagaaaaacagaaaccatagaccctttgaaagaagcagcaggctgcagcctacacccactgtgagccaggtgaaaaattgtaagtcctcagagtgtgacagggggagagactgcctccaggatatacatccccaccaggtaacctggcaattcagcccacaggggaaggccttaaccatacccagcactggaactaatatagggagtggtggggtaatataaaagtaggagcagcagcaagcagagccttgcatgcattcctagtctccagcacagaccgagggaagccactcctgattctacgtcacagagggcctcacggaagtcaactagctcaggcagaggttgcaggttgaaagaagctcccaactgaaattcatataatcttgagtggggatgaactccct

SEQ ID NO: 277140 - DNA, 674 bp, Homo sapiens
aaatatatttcaaagaaaagagttcacatttaaataaagtaataaatgattacaagtagggtttattacaggcatgcatggctgtttcaatatttgaaaatcaatcaatctaaactaccatgtggataggctaagaaaaatcacattttgttttgtttttcttcccaagatggtggattggaaacagtgtcagcatgactctcccacttggaaagacaaaatggtgagtagaaattcatactgtgaacttttttctaagaagcaatgcaggaactgaacagaaaaacagaaaccatagaccctttgaaagaagcagcaggctgcagcctacacccactgtgagccaggtgaaaaattgtaagtcctcagagtgtgacagggggagagactgcctccaggatatacatccccaccaggtaacctggcaattcagcccacaggggaaggccttaaccatacccagcactggaactaatatagggagtggtggggtaatataaaagtaggagcagcagcaagcagagccttgcatgcattcctagtctccagcacagaccgagggaagccactcctgattctacgtcacagagggcctcacggaagtcaactagctcaggcagaggttgcaggttgaaagaagctcccaactgaaattcatataatcttgagtgggg

SEQ ID NO: 277141 - DNA, 821 bp, Homo sapiens
  misc_feature (793)..(793): n is a, c, g, or t
  misc_feature (821)..(821): n is a, c, g, or t
gctagcggaacgactctcttaatttttccaccgctacacaaagcgtggatacccatcaacgaagttttgatattggaattcagattggctatcagcgacgcaataaggatgtgttggcttgggttaaaaaacgcagaagaactattcgtcgagaagatttgatcagcttcctgtgtggaaaagttcctccaccacgaaactctagagctcccccaagactgactgtagtgtcccctaaccgagctacttcaacggaaactagctcatctgtagagactgatttgcaacccttccgggaagccatagctctgcatggtcttagtggtgcaatggctagtataagcgtgcgttcgagtaccccaggctctcctacacatgtaagcagtggatcgaatgctagtcgaaggagaaatggactccatgatgtcgatttgaacactttcatatcagaagaaatggcactccacttggacaatggtggaactagaaagcgtacctcagcccagtgtggcgatgtcattacagactcaccaacccataaacgcaacagaatgatctaaactgcaaacattttcacacccaccatgctgcttgaaagccacttgatcctcaacatatactataattggcaaagggaaactgaggccatcttcccttgttcactgtttaagacaagtgaattctatagtggttgccataaaaggaagttctaggtatttatagtagatgcctcttggaattatggctttcttaaaactataatcctagcagaggacatcagattttgtgtagncggtggcaagatcatcctaggccaacan

SEQ ID NO: 277142 - DNA, 1810 bp, Homo sapiens
  misc_feature (1782)..(1782): n is a, c, g, or t
  misc_feature (1810)..(1810): n is a, c, g, or t
gcccccttggctcggacgcaaccactgtcagctcctccccctcctcctccttcatccttcctgacattcactcccttcccccagccaattggttacgtcaggcagacaggccgaagaaccaatcacgacgctgtgctcagaagccgccacgcggaaccggccggatccgactaataggggcccttggagcggccacgcctcaaccgggcagggtagcttgggcccagtgggcggtgcttctcctgtcagcatgtgggcggggtagggcggggaccagcagccgcagagccgtcctcggcggtggcgacgacgacgacgttgctcagtcttggggtgggctccgcggtgcaggccgagctgcgcggagggctcggcgatcagcggcggcggcggcagtggggaggccgcagcgccatgggggggcgttagacaggctgcggcggccgaggcgaggggcggcagcggttatctggtccgcggcgaccttcggccgggcccgggggtgggaaggcctggggcgggggtcgtccctggttgcacggggccgcggggcggggctcgccggccgtcggggtgcaggaggcctgggccgctgaaaggagaaggcgccgtcggtcgccaggccctgccgccgggccgcttgacgacgacgctcccgcgggggccccgcctgaggaggacgcggcggcggtggcggcgaggccgcgggaggccgcggaggatggaggagcggaaggaggagggcgaggccgagatccaggagcacgggcccgagcactggttctccaagtgggagcggcagtgcctggccgaggccgaacaggacgagcagctgccccccgagctgcaggaggaggcggcggccgccgcgcagcccgagcacaagcagcagaagctgtggcacctcttccagaactcggccaccgccgtggcccagctctacaaagaccgagtgtgtcagcagccaggactttctctctgggtccccttccaaaacgcagccaccgccgtcaccaatctctacaaagaaagcgtggatacccatcaacgaagttttgatattggaattcagattggctatcagcgacgcaataaggatgtgttggcttgggttaaaaaacgcagaagaactattcgtcgagaagatttgatcagcttcctgtgtggaaaagttcctccaccacgaaactctagagctcccccaagactgactgtagtgtcccctaaccgagctacttcaacggaaactagctcatctgtagagactgatttgcaacccttccgggaagccatagctctgcatggtcttagtggtgcaatggctagtataagcgtgcgttcgagtaccccaggctctcctacacatgtaagcagtggatcgaatgctagtcgaaggagaaatggactccatgatgtcgatttgaacactttcatatcagaagaaatggcactccacttggacaatggtggaactagaaagcgtacctcagcccagtgtggcgatgtcattacagactcaccaacccataaacgcaacagaatgatctaaactgcaaacattttcacacccaccatgctgcttgaaagccacttgatcctcaacatatactataattggcaaagggaaactgaggccatcttcccttgttcactgtttaagacaagtgaattctatagtggttgccataaaaggaagttctaggtatttatagtagatgcctcttggaattatggctttcttaaaactataatcctagcagaggacatcagattttgtgtagncggtggcaagatcatcctaggccaacan

SEQ ID NO: 277143 - DNA, 1483 bp, Homo sapiens
acagcccctgctctgccctgccctgcaaggcagcctcactgcttgcccctctccattacatctgctatggagtccaactgagcctcatctgccccttgaacgcacactctttctcctctgggagtctctgaagtgggtaatatcctctgcttataatatgcttccccttaaaccctctactctcttcctagctagctttgactcctctgtcacttgtccgctttggcatcacctcctcatagaagacttctatgactcccgagattctcaggagcatggcaggtgaagtgctcctcccctgaatggatggagattaaggagtgtgtgttattcatgcttaattcaccagtgcttagctgagtacctggcataaaatagttactgtggtggccaaagtaataacccccaccgccgtcaccaatctctacaagaaagcgtggatacccatcaacgaagttttgatattggaattcagattggctatcagcgacgcaataaggatgtgttggcttgggttaaaaaacgcagaagaactattcgtcgagaagatttgatcagcttcctgtgtggaaaagttcctccaccacgaaactctagagctcccccaagactgactgtagtgtcccctaaccgagctacttcaacggaaactagctcatctgtagagactgatttgcaacccttccgggaagccatagctctgcatggtaaagccgtttaaacatatttctttggaaaaatggttaagagggtgcctgtggacccatttttcacggttaggtttaggtccagatatactgttttttgtcttacagtaaacagcttgctctagaaatgtttaatagaatgtaagctaagaacttaatatgggcgatttctgtcagctaacctatcctagaaaatgtttttagaaagttagtttgagcttattggtgttaaaatgacatatctttctgcagtgttgattagaatttatcgctttacacttatgtgttgtacgtgtttttttcctcttctgaagtcaaagaggaagttcttgtgtcttaagaattctgttatatttctaatggtccatgacaggcaagtaaggtgggaaattgttgggttagttctcatgggacctgggacctcccttgacacctttcttacttggtttgctgtagatggtgggagaggatggatgtaagacttgaccttctgcctgtcgtccctcaggtcccttgcactttaagaggcaggaccagcagagtgcagccagtgggcaggtggatctctatctccccaggccagacctgtcataagaaggcactcttggctaagggattttagtattgctggagaaacccgggaaatgtagtcagtgataagtctgttgttgcttgttgctgtctaatacagacttccaaatagagctgggagagttaacctgtgtgacagcattgaatactgctgtaggaaaaaaagcaacagaataataagactt

SEQ ID NO: 277144 - DNA, 447 bp, Homo sapiens
gagcgtggcctgaggcatgtgcaatatttagacatctgttgaatgatgtgatgcaagttattttaggtaatttcattaaagatacctaatctctctgtttctgttaaatttttttttttaacaagccaagctccaggactgtgataagtaaacactgaatttagaccattaagattaaatgttacatataacattttcattatgactgaaatcatttcagtttatattactgatgggctcagaggccacatcatggtattcactttggttaaattgtaaaatggttttctttagaagggaatacgggctctaatggtcatgatacatgttttctttttctttttttctaacagaaagcgtggatacccatcaacgaagttttgatattggaattcagattggctatcagcgacgcaataaggatgtgttggcttgggttaaaaaacg

SEQ ID NO: 277145 - DNA, 2080 bp, Homo sapiens
gcccccttggctcggacgcaaccactgtcagctcctccccctcctcctccttcatccttcctgacattcactcccttcccccagccaattggttacgtcaggcagacaggccgaagaaccaatcacgacgctgtgctcagaagccgccacgcggaaccggccggatccgactaataggggcccttggagcggccacgcctcaaccgggcagggtagcttgggcccagtgggcggtgcttctcctgtcagcatgtgggcggggtagggcggggaccagcagccgcagagccgtcctcggcggtggcgacgacgacgacgttgctcagtcttggggtgggctccgcggtgcaggccgagctgcgcggagggctcggcgatcagcggcggcggcggcagtggggaggccgcagcgccatgggggggcgttagacaggctgcggcggccgaggcgaggggcggcagcggttatctggtccgcggcgaccttcggccgggcccgggggtgggaaggcctggggcgggggtcgtccctggttgcacggggccgcggggcggggctcgccggccgtcggggtgcaggaggcctgggccgctgaaaggagaaggcgccgtcggtcgccaggccctgccgccgggccgcttgacgacgacgctcccgcgggggccccgcctgaggaggacgcggcggcggtggcggcgaggccgcgggaggccgcggaggatggaggagcggaaggaggagggcgaggccgagatccaggagcacgggcccgagcactggttctccaagtgggagcggcagtgcctggccgaggccgaacaggacgagcagctgccccccgagctgcaggaggaggcggcggccgccgcgcagcccgagcacaagcagcagaagctgtggcacctcttccagaactcggccaccgccgtggcccagctctacaaagaccgagtgtgtcagcagccaggactttctctctgggtccccttccaaaacgcagccaccgccgtcaccaatctctacaaagaaagcgtggatacccatcaacgaagttttgatattggaattcagattggctatcagcgacgcaataaggatgtgttggcttgggttaaaaaacgcagaagaactattcgtcgagaagatttgatcagcttcctgtgtggaaaagttcctccaccacgaaactctagagctcccccaagactgactgtagtgtcccctaaccgagctacttcaacggaaactagctcatctgtagagactgatttgcaacccttccgggaagccatagctctgcatggtaaagccgtttaaacatatttctttggaaaaatggttaagagggtgcctgtggacccatttttcacggttaggtttaggtccagatatactgttttttgtcttacagtaaacagcttgctctagaaatgtttaatagaatgtaagctaagaacttaatatgggcgatttctgtcagctaacctatcctagaaaatgtttttagaaagttagtttgagcttattggtgttaaaatgacatatctttctgcagtgttgattagaatttatcgctttacacttatgtgttgtacgtgtttttttcctcttctgaagtcaaagaggaagttcttgtgtcttaagaattctgttatatttctaatggtccatgacaggcaagtaaggtgggaaattgttgggttagttctcatgggacctgggacctcccttgacacctttcttacttggtttgctgtagatggtgggagaggatggatgtaagacttgaccttctgcctgtcgtccctcaggtcccttgcactttaagaggcaggaccagcagagtgcagccagtgggcaggtggatctctatctccccaggccagacctgtcataagaaggcactcttggctaagggattttagtattgctggagaaacccgggaaatgtagtcagtgataagtctgttgttgcttgttgctgtctaatacagacttccaaatagagctgggagagttaacctgtgtgacagcattgaatactgctgtaggaaaaaaagcaacagaataataagactt

SEQ ID NO: 277146 - DNA, 491 bp, Homo sapiens
ttctttaggtattacatgaaacctttcctaaacatacatttctgatgaacggcttaattcaaggagtaaagggtttgttgtcattccttagtgccccgcttattggtgctctttctgatgtttggggccgaaaatccttcttgctgctaacggtgtttttcacatgtgccccaattcctttaatgaagatcagcccatggtggtactttgctgttatctctgtttctggggtttttgcagtgactttttctgtggtatttgcatacgtagcagatataacccaagagcatgaaagaagtatggcttatggactggtatgtatgtttattctataccttttgtatctgctgagaaatgccttgtttttaagataaatattattataaggagtgcaaacctttgcattacaagatttttgcgtaaaatatattttgtaataaaatcattcattagactacatttaaaatttttttgcggtatgaggctatgta

SEQ ID NO: 277147 - DNA, 2464 bp, Homo sapiens
ttctttaggtattacatgaaacctttcctaaacatacatttctgatgaacggcttaattcaaggagtaaagggtttgttgtcattccttagtgccccgcttattggtgctctttctgatgtttggggccgaaaatccttcttgctgctaacggtgtttttcacatgtgccccaattcctttaatgaagatcagcccatggtggtactttgctgttatctctgtttctggggtttttgcagtgactttttctgtggtatttgcatacgtagcagatataacccaagagcatgaaagaagtatggcttatggactggtttcagcaacatttgctgcaagtttagtcaccagtcctgcaattggagcttatcttggacgagtatatggggacagcttggtggtggtcttagctacagcaatagctttgctagatatttgttttatccttgttgctgtgccagagtcgttgcctgagaaaatgcggccagcatcctggggagcacccatttcctgggaacaagctgacccttttgcgtccttaaaaaaagtcggccaagattccatagtgctgctgatctgcattacagtgtttctctcctacctaccggaggcaggccaatattccagcttttttttatacctcagacagataatgaaattttcaccagaaagtgttgcagcgtttatagcagtccttggcattctttccattattgcacagaccatagtcttgagtttacttatgaggtcaattggaaataagaacaccattttactgggtctaggatttcaaatattacagttggcatggtatggctttggttcagaaccttggatgatgtgggctgctggggcagtagcagccatgtctagcatcacctttcctgctgtcagtgcacttgtttcacgaactgctgatgctgatcaacagggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttcttgccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattatttaaaaaagtgttactttgtaaaaattgtatataaagaactgtatagtttacactgttttcatcttgtgtgtggttattgcttaatgctttttaaacttggaacactcactatggttaaataaggtcttaaaagaaatgtaaatattctgttaataaagttaaatattttaatgatttttttttta

SEQ ID NO: 277148 - DNA, 2350 bp, Homo sapiens
ttctttaggtattacatgaaacctttcctaaacatacatttctgatgaacggcttaattcaaggagtaaagggtttgttgtcattccttagtgccccgcttattggtgctctttctgatgtttggggccgaaaatccttcttgctgctaacggtgtttttcacatgtgccccaattcctttaatgaagatcagcccatggtggtactttgctgttatctctgtttctggggtttttgcagtgactttttctgtggtatttgcatacgtagcagatataacccaagagcatgaaagaagtatggcttatggactggtttcagcaacatttgctgcaagtttagtcaccagtcctgcaattggagcttatcttggacgagtatatggggacagcttggtggtggtcttagctacagcaatagctttgctagatatttgttttatccttgttgctgtgccagagtcgttgcctgagaaaatgcggccagcatcctggggagcacccatttcctgggaacaagctgacccttttgcgataatgaaattttcaccagaaagtgttgcagcgtttatagcagtccttggcattctttccattattgcacagaccatagtcttgagtttacttatgaggtcaattggaaataagaacaccattttactgggtctaggatttcaaatattacagttggcatggtatggctttggttcagaaccttggatgatgtgggctgctggggcagtagcagccatgtctagcatcacctttcctgctgtcagtgcacttgtttcacgaactgctgatgctgatcaacagggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttcttgccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattatttaaaaaagtgttactttgtaaaaattgtatataaagaactgtatagtttacactgttttcatcttgtgtgtggttattgcttaatgctttttaaacttggaacactcactatggttaaataaggtcttaaaagaaatgtaaatattctgttaataaagttaaatattttaatgatttttttttta

SEQ ID NO: 277149 - DNA, 2877 bp, Homo sapiens
ttctttaggtattacatgaaacctttcctaaacatacatttctgatgaacggcttaattcaaggagtaaagggtttgttgtcattccttagtgccccgcttattggtgctctttctgatgtttggggccgaaaatccttcttgctgctaacggtgtttttcacatgtgccccaattcctttaatgaagatcagcccatggtggtactttgctgttatctctgtttctggggtttttgcagtgactttttctgtggtatttgcatacgtagcagatataacccaagagcatgaaagaagtatggcttatggactggtttcagcaacatttgctgcaagtttagtcaccagtcctgcaattggagcttatcttggacgagtatatggggacagcttggtggtggtcttagctacagcaatagctttgctagatatttgttttatccttgttgctgtgccagagtcgttgcctgagaaaatgcggccagcatcctggggagcacccatttcctgggaacaagctgacccttttgcgtccttaaaaaaagtcggccaagattccatagtgctgctgatctgcattacagtgtttctctcctacctaccggaggcaggccaatattccagcttttttttatacctcagacagataatgaaattttcaccagaaagtgttgcagcgtttatagcagtccttggcattctttccattattgcacagaccatagtcttgagtttacttatgaggtcaattggaaataagaacaccattttactgggtctaggatttcaaatattacagttggcatggtatggctttggttcagaaccttggatgatgtgggctgctggggcagtagcagccatgtctagcatcacctttcctgctgtcagtgcacttgtttcacgaactgctgatgctgatcaacagggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttcttgccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattatttaaaaaagtgttactttgtaaaaattgtatataaagaactgtatagtttacactgttttcatcttgtgtgtggttattgcttaatgctttttaaacttggaacactcactatggttaaataaggtcttaaaagaaatgtaaatattctgttaataaagttaaatattttaatgattttttttttaaaaaagtcttgatctgtgagttcctacagggtctgttttggctttgttaccatatttttacagtaacaaatcaaagcattattcattctttctttgcatccatttcttttccctcactaaaaaatgctcttcaaggaagacaagaggaaagaaacaaaaatgcagtatgcgttttgaagtacttgattttcaaagtgtagatgctgcataatagtttattaacaaagctcaaagtttacagaaataacattaaatgcaacactttttgattattaacacatgtacaattttacactgcaaaacaattgcaactaaaagtttaggaggtaaagaattagcacacttggaagtctgtatacatttaatacaaatttgcaagatatcagaatgatctctcctgaaaattcaacttt

SEQ ID NO: 277150 - DNA, 311 bp, Homo sapiens
ataatgaaattttcaccagaaagtgttgcagcgtttatagcagtccttggcattctttccattattgcacaggtgagtttctttttttagttagagtgatgtcagtgaccctggctggccatccaaactggggcctcatctagtgatggtatcttggtggaatcaacaaagtcaggagtctgaggttgataggttcagaaattcaatttgtttgtgtagctagtgttgatcagatttttgggactgacacatttaatataggatatataaacgtaaaagctagtttattgatgtatactaggatatatgtc

SEQ ID NO: 277151 - DNA, 311 bp, Homo sapiens
gtttttgttttgctgctctccttataggatgatgtgggctgctggggcagtagcagccatgtctagcatcacctttcctgctgtcagtgcacttgtttcacgaactgctgatgctgatcaacagggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacagcttagtcaagacatagacctca

SEQ ID NO: 277152 - DNA, 2332 bp, Homo sapiens
gcaagacccagttcccccactctcgcccccacaagaaaaaaagataaatggcacaggtaggaagagaaaagggagggtgtgcaacagaaggcctgacataaatcaagattatgaaaggagttatgtggtgttgaggaaaaaagtagcctgactaatctctgtctatccttaatttattgcaggtttcagcaacatttgctgcaagtttagtcaccagtcctgcaattggagcttatcttggacgagtatatggggacagcttggtggtggtcttagctacagcaatagctttgctagatatttgttttatccttgttgctgtgccagagtcgttgcctgagaaaatgcggccagcatcctggggagcacccatttcctgggaacaagctgacccttttgcgtccttaaaaaaagtcggccaagattccatagtgctgctgatctgcattacagtgtttctctcctacctaccggaggcaggccaatattccagcttttttttatacctcagacagataatgaaattttcaccagaaagtgttgcagcgtttatagcagtccttggcattctttccattattgcacagaccatagtcttgagtttacttatgaggtcaattggaaataagaacaccattttactgggtctaggatttcaaatattacagttggcatggtatggctttggttcagaaccttggatgatgtgggctgctggggcagtagcagccatgtctagcatcacctttcctgctgtcagtgcacttgtttcacgaactgctgatgctgatcaacagggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttcttgccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattatttaaaaaagtgttactttgtaaaaattgtatataaagaactgtatagtttacactgttttcatcttgtgtgtggttattgcttaatgctttttaaacttggaacactcactatggttaaataaggtcttaaaagaaatgtaaatattctgttaataaagttaaatattttaatgatttttttttta

SEQ ID NO: 277153 - DNA, 2336 bp, Homo sapiens
ttctttaggtattacatgaaacctttcctaaacatacatttctgatgaacggcttaattcaaggagtaaagggtttgttgtcattccttagtgccccgcttattggtgctctttctgatgtttggggccgaaaatccttcttgctgctaacggtgtttttcacatgtgccccaattcctttaatgaagatcagcccatggtggtactttgctgttatctctgtttctggggtttttgcagtgactttttctgtggtatttgcatacgtagcagatataacccaagagcatgaaagaagtatggcttatggactggtttcagcaacatttgctgcaagtttagtcaccagtcctgcaattggagcttatcttggacgagtatatggggacagcttggtggtggtcttagctacagcaatagctttgctagatatttgttttatccttgttgctgtgccagagtcgttgcctgagaaaatgcggccagcatcctggggagcacccatttcctgggaacaagctgacccttttgcgtccttaaaaaaagtcggccaagattccatagtgctgctgatctgcattacagtgtttctctcctacctaccggaggcaggccaatattccagcttttttttatacctcagacagataatgaaattttcaccagaaagtgttgcagcgtttatagcagtccttggcattctttccattattgcacagaccatagtcttgagtttacttatgaggtcaattggaaataagaacaccattttactgggtctaggatttcaaatattacagttggcatggtatggctttggttcagaaccttggatgatgtgggctgctggggcagtagcagccatgtctagcatcacctttcctgctgtcagtgcacttgtttcacgaactgctgatgctgatcaacagggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttcttgccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattatttaaaaaagtgttactttgtaaaaattgtatataaagaactgtatagtttacactgtt

SEQ ID NO: 277154 - DNA, 1305 bp, Homo sapiens
gcagccagctaattaatcccatccggttattacatggggattctgagggataaagggagatggagaagctggagggggcatttgggttgatgcagcacttgtgaaggctgaatggcaatgacagtggctgccctcggtccagaacacggggtgggaacacgtcctcctcactgtcactggctccctctgcagttggctcccagcctgcggggcacttaggtagatggtagcatgggcagggggccaggtcggaggacccatgctcgagaaacacattcgcagacacatccgctagggctcccagttctttaatctgggggacaggtctccccctaaaacactcactctcccacaatgggaagaaccctggtgtccagagctacctcctcctccccaggtccccaagctaggccagggaagtgactctggctgttagccacagcccacgcctacccttgccctgtgattcagacacccgagttcagagccagcctccaagagtatcttacatcccagcgtctcctggaaggccgtatgatccagcactggggagaggagggaaatccccaggactcgaatgcccatcccacccttggtgtagtgaggactcatcctgctggaaaggcccctgaagaacttcaagttccaatgtcccgtttttacagatggggaaactgacatgaagaggagtccaaagtgacacagtcaggccagaaatgttgcttctgaagtcctgagtccacctcctagcactgccaagcagtccacctggaggtgatgagaacttccaggctttggtaatggacaactctgtatccctggagccttcattccttttggcattacagaaccacaagaagtcatctagaatcattgagattctcaactccattgggcaaactggaaccagcaaaatctcagatatctagaattgccactgcttccttgactctgtgatcagtctacagccacagaatcctgattccctttggacattctagaatggcactttaaaaaaaaacaacccacccagtggatcctttcaaagcactgcttattctcttggctgggtgctctacagccagaagttggagttatctaatatcaagaactcttaatctgtcacttcagtctttctaaacccacagactaacaatgttttgtgcattctagaaacattactctttagtttctggagtagttcaactctccacgtaaaatctgtcctagactcaccagtgcttgcctctgtggtcaacctagactcacagaatctcaactaatgagctttctggaaccacaggt

SEQ ID NO: 277155 - DNA, 911 bp, Homo sapiens
ggctttcgggccccgccggaagcccgtccagcgcccaacaaaagcggcgcgacaagtctacgactgagccgaacgcttctgggcgccgcgcgccagggggaaacgttcgcggcggaacgttcaggagaaaacgctccagcaactcccagccgaccccgcccctccccgacctaccatagacgccgtcctccatggcggctaggaaggcccgcggggaatccggggcggtcccgccagtcgggcctggatccgcgttggcccgcgggctcggatggggaaactgacatgaagaggagtccaaagtgacacagtcaggccagaaatgttgcttctgaagtcctgagtccacctcctagcactgccaagcagtccacctggaggtgatgagaacttccaggctttggtaatggacaactctgtatccctggagccttcattccttttggcattacagaaccacaagaagtcatctagaatcattgagattctcaactccattgggcaaactggaaccagcaaaatctcagatatctagaattgccactgcttccttgactctgtgatcagtctacagccacagaatcctgattccctttggacattctagaatggcactttaaaaaaaaacaacccacccagtggatcctttcaaagcactgcttattctcttggctgggtgctctacagccagaagttggagttatctaatatcaagaactcttaatctgtcacttcagtctttctaaacccacagactaacaatgttttgtgcattctagaaacattactctttagtttctggagtagttcaactctccacgtaaaatctgtcctagactcaccagtgcttgcctctgtggtcaacctagactcacagaatctcaactaatgagctttctggaaccacaggt

SEQ ID NO: 277156 - DNA, 774 bp, Homo sapiens
ctccgaaacaacagaaagcacttgacaggcttgctctccaatgagaagccccggaaaagtgtcgcgcggaggcggagccacgcggtacagccacctctgcgcctgctcaaaggccctggacacttggagtctagatggggaaactgacatgaagaggagtccaaagtgacacagtcaggccagaaatgttgcttctgaagtcctgagtccacctcctagcactgccaagcagtccacctggaggtgatgagaacttccaggctttggtaatggacaactctgtatccctggagccttcattccttttggcattacagaaccacaagaagtcatctagaatcattgagattctcaactccattgggcaaactggaaccagcaaaatctcagatatctagaattgccactgcttccttgactctgtgatcagtctacagccacagaatcctgattccctttggacattctagaatggcactttaaaaaaaaacaacccacccagtggatcctttcaaagcactgcttattctcttggctgggtgctctacagccagaagttggagttatctaatatcaagaactcttaatctgtcacttcagtctttctaaacccacagactaacaatgttttgtgcattctagaaacattactctttagtttctggagtagttcaactctccacgtaaaatctgtcctagactcaccagtgcttgcctctgtggtcaacctagactcacagaatctcaactaatgagctttctggaaccacaggt

SEQ ID NO: 277157 - DNA, 514 bp, Homo sapiens
ctgggcctcccccttcccttgtccactaattagccctgtgccctacagggtctcaccttcaccttcaccttccaggtcaggccagaaatgttgcttctgaagtcctgagtccacctcctagcactgccaagcagtccacctggaggtgatgagaacttccaggctttggtaatggacaactctgtatccctggagccttcattccttttggcattacagaaccacaagaagtcatctagaatcattgagattctcaactccattgggcaaactggaaccagcaaaatctcagatatctagaattgccactgcttccttgactctgtgatcagtctacagccacagaatcctgattccctttggacattctagaatggcactttaaaaaaaaacaacccacccagtggatcctttcaaagcactgcttattctcttggctgggtgctctacagccagaagttggagttatctaatatcaagaactcttaatctgtcacttcagtctttctaaacc

SEQ ID NO: 277158 - DNA, 670 bp, Homo sapiens
gctttttcgccccgcccttcaaatgcgaaagcgactgccttcttggaacactcaaaactagcatctgatgaatgcctacattcagtccacaaagcaacaatcttataagctgctcgtcgggcatgatggctcacacctgtaattccagcactctgggaggccaaggcaggtggatcgccggagctccggaattcaagatcagcctggccaacaggggaaaactccgtttctactaaaaatacaaaaattagctgggtgtggtggcactcacctgtagtcctagctactaggaaggctgaggcaggagaatcgcttgaacccaggaggcggaggttgcagtgagccgacagtgccactgcactccagcctgggcaacagagagactccatctcaatcagtcaatcactaagctgctaccaagggagccatttaagtcttgagctgctacagctcctccctttaacaagaataccatagtactttagaagatacctgcctctactaaatttggcacttcattctcagacataccactctttcaattctgatccaattctactattaagacatctaaactaaaaagggcaagagtgagttattaaacttgggctcaagttctacaagtaacctatattacccaagatatttctgacaagtagctccagagtag

SEQ ID NO: 277159 - DNA, 290 bp, Homo sapiens
gttgaaatggagtctcactctgtcacccagctgctaccaagggagccatttaagtcttgagctgctacagctcctccctttaacaagaataccatagtactttagaagatacctgcctctactaaatttggcacttcattctcagacataccactctttcaattctgatccaattctactattaagacatctaaactaaaaagggcaagagtgagttattaaacttgggctcaagttctacaagtaacctatattacccaagatatttctgacaagtagctccagagtag

SEQ ID NO: 277160 - DNA, 541 bp, Homo sapiens
gcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcaggtataaaacttgattgaccatttaaagttagtttttataatcagtaaagtgaaatgtttcatacataccagaaatatttatttgtaaaagaatctcttgaaaagaatttggtaatgctttacctgggatatttgaaggaaatttactccatggattgcccttaatttaacttattgtaagtttggggtgcatttttacatttacttattaattcatatctacacaaatgactagaaa

SEQ ID NO: 277161 - DNA, 1900 bp, Homo sapiens
gcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctggtaagtactcaagtagttttcatttatgaaattataactttattcttttctaatgccattaactttctcccttattttcctttatttgtgttaatgcagtgaattacattgattttgttactattaagacaactttgcattcttgaaataaatccaagtttataatgtaccacttgcaacccagaagtcaccatctaattgtggactgtcttgatttgaaactgatgtctgtaaattctggtctatttcttactcccccttattcttagaaggtaactccacgttacctattcaaagcctgtagggttttctaaggcctgccttccttggcagacttctaattccaatttttgttctttaagcccctttgtcagactgcttag

SEQ ID NO: 277162 - DNA, 1953 bp, Homo sapiens
gcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctggtaagtactcaagtagttttcatttatgaaattataactttattcttttctaatgccattaactttctcccttattttcctttatttgtgttaatgcagtgaattacattgattttgttactattaagacaactttgcattcttgaaataaatccaagtttataatgtaccacttgcaacccagaagtcaccatctaattgtggactgtcttgatttgaaactgatgtctgtaaattctggtctatttcttactcccccttattcttagaaggtaactccacgttacctattcaaagcctgtagggttttctaaggcctgccttccttggcagacttctaattccaatttttgttctttaagcccctttgtcagactgcttag

SEQ ID NO: 277163 - DNA, 1987 bp, Homo sapiens
ccccaagccatcactggcagcttgggcagaagctggagggccttctgagacaggtgggcgaggtctgccgccaggacatccaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcagggacatgcggctatcaatcacggggaccttggcagagagcattgtggctcaggctttggcaggcctgagtgcagcccgggatcagctggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagggcggcgagcagtgtctgtgcatgaggaccagctccaggcccctgctgaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctgatcctctcctctcctgccgcatgagattattttattaaaaaactcaaaggaagcaga

SEQ ID NO: 277164 - DNA, 2020 bp, Homo sapiens
ccccaagccatcactggcagcttgggcagaagctggagggccttctgagacaggtgggcgaggtctgccgccaggacatccaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcagggacatgcggctatcaatcacggggaccttggcagagagcattgtggctcaggctttggcaggcctgagtgcagcccgggatcagctggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagatggccagctgaggccgaggcctctctcggcagggcggcgagcagtgtctgtgcatgaggaccagctccaggcccctgctgaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctgatcctctcctctcctgccgcatgagattattttattaaaaaactcaaaggaagcaga

SEQ ID NO: 277165 - DNA, 2378 bp, Homo sapiens
ccccaagccatcactggcagcttgggcagaagctggagggccttctgagacaggtgggcgaggtctgccgccaggacatccaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcagggacatgcggctatcaatcacggggaccttggcagagagcattgtggctcaggctttggcaggcctgagtgcagcccgggatcagctggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtctggtacctgagtccccagctccgccttgcaggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagggcggcgagcagtgtctgtgcatgaggaccagctccaggcccctgctggtgaggggagacacctccacgtgtgcttgaatgcaggagatgtgggagggtgggcttctggggctcccttcatagctttggtccttggagggagccaccagtgtgtgaggtctcaagaaatcagggagccagaagaccaggtgcaagggtttgacagcaagcccttccaactagcactggctccacttcccgaagagcagcctctgccaggggtgaggacgcagggacgggggatgctctgaaggcagcagtgtgtgtgagtgcatgcttatgtgcactggaggtggaagagaggggcaggggatggacagaccccaagccttagcaacccaccccaagcctttctgtgtcccttagaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctgatcctctcctctcctgccgcatgagattattttattaaaaaactcaaaggaagcaga

SEQ ID NO: 277166 - DNA, 383 bp, Homo sapiens
aagtcggcctgaatttagaaatattcaagtgtgcaaagagttctaagagggctgtactgggtttgccatgttcttgtccagcccatggtgggcattcagtggcaggattataagaacaagaacgaacaaaaggctagggtgtggggagcgggcagggctggaatctgattgccctgtttcctgcagagcaaagatggcgagatcaagaaagctggctcagatggtaagtgggaccctggggtgtggcagtacatttgccaggaggtgtccttatagacagcccccaaggcacttgctctccttggggaggaaggggagaggccaggtttttcttcccctcacctccaaggtctggtacctgagtccccagctccgccttgcag

SEQ ID NO: 277167 - DNA, 2344 bp, Homo sapiens
ccccaagccatcactggcagcttgggcagaagctggagggccttctgagacaggtgggcgaggtctgccgccaggacatccaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcagggacatgcggctatcaatcacggggaccttggcagagagcattgtggctcaggctttggcaggcctgagtgcagcccgggatcagctggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagggcggcgagcagtgtctgtgcatgaggaccagctccaggcccctgctggtgaggggagacacctccacgtgtgcttgaatgcaggagatgtgggagggtgggcttctggggctcccttcatagctttggtccttggagggagccaccagtgtgtgaggtctcaagaaatcagggagccagaagaccaggtgcaagggtttgacagcaagcccttccaactagcactggctccacttcccgaagagcagcctctgccaggggtgaggacgcagggacgggggatgctctgaaggcagcagtgtgtgtgagtgcatgcttatgtgcactggaggtggaagagaggggcaggggatggacagaccccaagccttagcaacccaccccaagcctttctgtgtcccttagaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctgatcctctcctctcctgccgcatgagattattttattaaaaaactcaaaggaagcaga

SEQ ID NO: 277168 - DNA, 1939 bp, Homo sapiens
ccccaagccatcactggcagcttgggcagaagctggagggccttctgagacaggtgggcgaggtctgccgccaggacatccaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcagggacatgcggctatcaatcacggggaccttggcagagagcattgtggctcaggctttggcaggcctgagtgcagcccgggatcagctggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctgatcctctcctctcctgccgcatgagattattttattaaaaaactcaaaggaagcaga

SEQ ID NO: 277169 - DNA, 2061 bp, Homo sapiens
gatcatggctgaggccctacctgccatctttggctgcttggtattgcaggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagggcggcgagcagtgtctgtgcatgaggaccagctccaggcccctgctggtgaggggagacacctccacgtgtgcttgaatgcaggagatgtgggagggtgggcttctggggctcccttcatagctttggtccttggagggagccaccagtgtgtgaggtctcaagaaatcagggagccagaagaccaggtgcaagggtttgacagcaagcccttccaactagcactggctccacttcccgaagagcagcctctgccaggggtgaggacgcagggacgggggatgctctgaaggcagcagtgtgtgtgagtgcatgcttatgtgcactggaggtggaagagaggggcaggggatggacagaccccaagccttagcaacccaccccaagcctttctgtgtcccttagaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctgatcctctcctctcctgccgcatgagattattttattaaaaaactcaaaggaagcaga

SEQ ID NO: 277170 - DNA, 248 bp, Homo sapiens
gccgccacctccccgggctcggcgctcggtgctcttctggtgctgtcccctcaggtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccg

SEQ ID NO: 277171 - DNA, 1681 bp, Homo sapiens
tgccgccaccgccgcggcccgcgctgtaaccgcggctgccgctgctgctccgggcgggcgttggtgccgtgtgccgaggcgccctgtcaggcgatggggagcggctgggcggggagagccgacggccgcggcggcgcctgaggaacgcagccgggctcgggagcggcgagggcgggccggtccagcggcggaggagcgaggcggggcgaggcaggcggcgcggggaccccgcgccaagcagcggcggcctcggaggaagaggggtcgccgcccaggtttcttgcggccgccgctcttgtcgtcgcagtatttcctgttcggattatcttttgcttccccccagctgcctccttaccctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggtttgttgagatccaacagatatattccaacaatagctatattccaacaatagattaaatgaactctaagaggtgtatcatctgtttgactcttgcatccttcattgtgtgacctgtagcatagttatctgacttctttgtggttcattttcctcacttatgacatagatggataaaatgtcagacattagttgtttaattgagatgataatgtatgtaaaacatttcaagcagtttctggtatataataaactctataaatgattgagaagccatttttttaaggaa

SEQ ID NO: 277172 - DNA, 1189 bp, Homo sapiens
tgccgccaccgccgcggcccgcgctgtaaccgcggctgccgctgctgctccgggcgggcgttggtgccgtgtgccgaggcgccctgtcaggcgatggggagcggctgggcggggagagccgacggccgcggcggcgcctgaggaacgcagccgggctcgggagcggcgagggcgggccggtccagcggcggaggagcgaggcggggcgaggcaggcggcgcggggaccccgcgccaagcagcggcggcctcggaggaagaggggtcgccgcccaggtttcttgcggccgccgctcttgtcgtcgcagtatttcctgttcggattatcttttgcttccccccagctgcctccttaccctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaaggtagaattttttgtaaaaaattatatattaaatgcacaaattttagtatttttcaataaacatgctatttcaggatcacactta

SEQ ID NO: 277173 - DNA, 261 bp, Homo sapiens
accgccgcggcccgcgctgtaaccgcggctgccgctgctgctccgggcgggcgttggtgccgtgtgccgaggcgccctgtcaggcgatggggagcggctgggcggggagagccgacggccgcggcggcgcctgaggaacgcagccgggctcgggagcggcgagggcgggccggtccagcggcggaggagcgaggcggggcgaggcaggcggcgcggggacccacaccaggcgccttgtgtgcgaggccgagcggcggccgc

SEQ ID NO: 277174 - DNA, 1673 bp, Homo sapiens
tgccgccaccgccgcggcccgcgctgtaaccgcggctgccgctgctgctccgggcgggcgttggtgccgtgtgccgaggcgccctgtcaggcgatggggagcggctgggcggggagagccgacggccgcggcggcgcctgaggaacgcagccgggctcgggagcggcgagggcgggccggtccagcggcggaggagcgaggcggggcgaggcaggcggcgcggggaccccgcgccaagcagcggcggcctcggaggaagaggggtcgccgcccaggtttcttgcggccgccgctcttgtcgtcgcagtatttcctgttcggattatcttttgcttccccccagctgcctccttaccctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaatccctaccctttgagtatacatgagtcccctgttac

SEQ ID NO: 277175 - DNA, 1268 bp, Homo sapiens
tgccgccaccgccgcggcccgcgctgtaaccgcggctgccgctgctgctccgggcgggcgttggtgccgtgtgccgaggcgccctgtcaggcgatggggagcggctgggcggggagagccgacggccgcggcggcgcctgaggaacgcagccgggctcgggagcggcgagggcgggccggtccagcggcggaggagcgaggcggggcgaggcaggcggcgcggggaccccgcgccaagcagcggcggcctcggaggaagaggggtcgccgcccaggtttcttgcggccgccgctcttgtcgtcgcagtatttcctgttcggattatcttttgcttccccccagctgcctccttaccctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaaggtgaacggagcgcgcagccccgcgacaccgtcattgaaaaattggggttgttttaagggggctactcgggctttacatgggaatgcaagggaagagaacgccaataataataataataactctaataaaaggctcgctcctcccttggcaaacgtttcttcggtgggttgttttggagattgataccttactccttttcattgatttttctctctcccctttgcacatgcagcaatcagttcaaggttgcttcaaactattatccgacctttaatcgtattctgacactgccagtaataacctggaagcttttatattcaagcgttttaatatgattcaccaacttcgaagtttcctttggaaacggtgtctaatgaatgttgtttatcaaaaagccaaacctgttctaccacacctttgctcatcacttttcccttaaaatgtggtgtaagtggcttacgatatgaaatcacagggttctttttatcattatgtttgttaaaaagtactgagatttttgcctgttaatggcacgataattgccatagcgttctgtaattcaggaaagaatgatgcagcgaattaagtcaccagctgcttaatgaggaaacacaaacttgcctcggttttaatacctgccttt

SEQ ID NO: 277176 - DNA, 3451 bp, Homo sapiens
  misc_feature (1)..(1): n is a, c, g, or t
ngaggcccaagacccgcgggcttgcggaccggacgcaggcggcagatttgcagcccgggatgcgccagggaacagcctgcgcccccctccctcctctccgcccgctggccgggccaactccggcttctgccgcgcgtgcctggctcggagctccgctgcggaaaacccgagcgcgggcggctccccgcctcgccgcccgggaaaatccgggggtggccgccagggatctccaagcggcctgggctgggcggccggagcttccctcccggatttgcgccccgaacctggcgccctgaagctagaggcccgtcggtccagtccttgcctcccatcttctctccgcagagcgcccagacgacggcgagatgacggccgggagccccgaagaatgcggggaggtgcggaggagccccgagggccgcgtctctcgcttgggccgccgcctgggccgccgccggcgcccgcgctccccgcccgagcctctgcgggtgcgggcgcggctgcggctgcgctcgccgtcgggggcgttcgcggcgctgggggcgctcgtggtactggtgggtatgggcattgcagtggccggctactggccgcaccgggccggggccccagggtcccgggccgccaatgccagctcgccccagatgagcgagctgcgacgcgagggtcgcggcgggggccgggctcacggcccgcacgagcggctgcggctcctcgggccggtgatcatgggcgtcggcctgttcgtgttcatctgcgccaacacactgctgtatgagaaccgagacttggagacgcgacggctccgccagggggtgctgcgggcccaggcgctccggccccccgacggcccgggctgggactgcgccctccttcccagccccggccctaggagtccccgagccgtaggctgcgcagagccagaaatctgggacccgtccccgcgtcggggtacttcacccgtcccgtcagtgcggagtctgcgttcagagcccgctaatcctcgcttggggttacctgccttgctcaacagctacccgctgaagggccccgggctgcccccaccctggggtccacggacgcagactggccatgtgatcatcaccgtgcagccgtctggctcctgcattgaacattccaagtctctggatctgggccttggggagctcctccttggggccccagcagctcgggactgtgctcaccgaagctggccacggctggaccgcctcagtcttgggggctatgccaaattgggaggaggaggggacttgggggcccgggtctgaagagaggggagacagcctgctctgaggctgcagcatggaccatgctaataggaccaaaggaccaggagtcccaacgtctaatagatgtttcagtcacatcccaggctggggatggatgctctgaccacagcagctgtgaagggcatcctgacctgcatgcgggcagagaaatgccagctgcaccagggctcagtgagctggagagggtgcgtttcactgtggggtgtggaggactcgcctcaggaatttcttcagcctctgtaagtggccttagccctaacagggctggaggtccaggccagggtgactgggagatgtacccagtgtcttggcaaacccaagaaagtggtgggcaagggcccctaagactgggaggtaggttgggatgttacaggctggggcaggctccctccaaggcggcactggtgatggagtgtggggcctctgggaagatggaccacgggatgagactctccactgccatctgggacggggactgagccttgaactcctaccacctcaatccctttcttccctcagccatctggggtatatccctctagagctacactactgccaatgccttcatactgagttctgggcccctctgcaaataagtctgagaagccccttctctccttcctttatcgtggcctatgctgcagaatctcactgcagctggcaaaaggcattggccagctctcagaaatccctttactcaacgttgaagctgcattttggtcaatgtgggtaacttactttagaaaatgacttgagtttaggtctcccccacccatatttaatttttcccaagttgctggtagaagagaaatttaaaagtggatcaatcctcacagagagagttctttttgttgttgtttattgaaaaaaatgcaatacaagaagcaagaccaaacagatatctaaacactacaaccacttctactacgaaaggccaaaacagcagacttgattattgcctgtgtagtctaaagattctgccaatctgattctgctgcccgagttcctattttttcaagaaatgtaaacaactacttgatatgattcataattttaaaaaaatttacaaagctccttcatttttgtcaccaaaataatacatttgagagagatttgtagaaacaaccagcctggggctgagatcctgggcagaaatttcccgtgagcatcaaaaggcgtcagtcaggccgcagctctggctccagttcccgaggtttgttgtctcctcacccccagctgccaagcatccccccaacacacactgatgggcccagcggtggaggggggggtggggacggggatgggtcacggggccctgacgggtcccgcagttaggctccctgagccctcggcttataaatacaggtcttgctttgtgggtgggtgccagagtcctcatgtggcttggaggaaatctttatttctcaaattaaaataaaattgcagcgagagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggaggcgcaagaaaataaatattactcatcaggggggagagcaacgaattaagaagcgacgacacacgcagtagtttttagtagaggaaacaggggacgccacataagggaaggggatttattaataatacaacgaggaggtgggcggggagattataaaacaacgagttgtaagaggaagacaaaaaataatgagacaagaagcagggagagccaacttatgtgaaaggagaagagagacacaaaatcaaatattggcgggggaggggcggagaaccaaacaagaggaggggagaacacaaacacatcccacagtacaggagacgtatatataccgaccgcgcgcatgaggagggcggataatatataaacaacataccggataagagaggtgagattagataaggaggtggagagaaaaaacaagaagcgaggcaagtataatgtatacgcggtgtgggagagagtgagagaagtaatatgtttgtgaagataggaggaagagtatagtgatatttggtgcgagatatcatttcattagggaaggggggcgagctgtgtgtataagctatgagaaggaagaggac

SEQ ID NO: 277177 - DNA, 2764 bp, Homo sapiens
  misc_feature (1)..(1): n is a, c, g, or t
ngaggcccaagacccgcgggcttgcggaccggacgcaggcggcagatttgcagcccgggatgcgccagggaacagcctgcgcccccctccctcctctccgcccgctggccgggccaactccggcttctgccgcgcgtgcctggctcggagctccgctgcggaaaacccgagcgcgggcggctccccgcctcgccgcccgggaaaatccgggggtggccgccagggatctccaagcggcctgggctgggcggccggagcttccctcccggatttgcgccccgaacctggcgccctgaagctagaggcccgtcggtccagtccttgcctcccatcttctctccgcagagcgcccagacgacggcgagatgacggccgggagccccgaagaatgcggggaggtgcggaggagccccgagggccgcgtctctcgcttgggccgccgcctgggccgccgccggcgcccgcgctccccgcccgagcctctgcgggtgcgggcgcggctgcggctgcgctcgccgtcgggggcgttcgcggcgctgggggcgctcgtggtactggtgggtatgggcattgcagtggccggctactggccgcaccgggccggggccccagggtcccgggccgccaatgccagctcgccccagatgagcgagctgcgacgcgagggtcgcggcgggggccgggctcacggcccgcacgagcggctgcggctcctcgggccggtgatcatgggcgtcggcctgttcgtgttcatctgcgccaacacactgctgtatgagaaccgagacttggagacgcgacggctccgccagggggtgctgcgggcccaggcgctccggccccccgacggcccgggctgggactgcgccctccttcccagccccggccctaggagtccccgagccgtaggctgcgcagagccagaaatctgggacccgtccccgcgtcggggtacttcacccgtcccgtcagtgcggagtctgcgttcagagcccgctaatcctcgcttggggttacctgccttgctcaacagctacccgctgaagggccccgggctgcccccaccctggggtccacggacgcagactggccatgtgatcatcaccgtgcagccgtctggctcctgcattgaacattccaagtctctggatctgggccttggggagctcctccttggggccccagcagctcgggactgtgctcaccgaagctggccacggctggaccgcctcagtcttgggggctatgccaaattgggaggaggaggggacttgggggcccgggtctgaagagaggggagacagcctgctctgaggctgcagcatggaccatgctaataggaccaaaggaccaggagtcccaacgtctaatagatgtttcagtcacatcccaggctggggatggatgctctgaccacagcagctgtgaagggcatcctgacctgcatgcgggcagagaaatgccagctgcaccagggctcagtgagctggagagggtgcgtttcactgtggggtgtggaggactcgcctcaggaatttcttcagcctctgtaagtggccttagccctaacagggctggaggtccaggccagggtgactgggagatgtacccagtgtcttggcaaacccaagaaagtggtgggcaagggcccctaagactgggaggtaggttgggatgttacaggctggggcaggctccctccaaggcggcactggtgatggagtgtggggcctctgggaagatggaccacgggatgagactctccactgccatctgggacggggactgagccttgaactcctaccacctcaatccctttcttccctcagccatctggggtatatccctctagagctacactactgccaatgccttcatactgagttctgggcccctctgcaaataagtctgagaagccccttctctccttcctttatcgtggcctatgctgcagaatctcactgcagctggcaaaaggcattggccagctctcagaaatccctttactcaacgttgaagctgcattttggtcaatgtgggtaacttactttagaaaatgacttgagtttaggtctcccccacccatatttaatttttcccaagttgctggtagaagagaaatttaaaagtggatcaatcctcacagagagagttctttttgttgttgtttattgaaaaaaatgcaatacaagaagcaagaccaaacagatatctaaacactacaaccacttctactacgaaaggccaaaacagcagacttgattattgcctgtgtagtctaaagattctgccaatctgattctgctgcccgagttcctattttttcaagaaatgtaaacaactacttgatatgattcataattttaaaaaaatttacaaagctccttcatttttgtcaccaaaataatacatttgagagagatttgtagaaacaaccagcctggggctgagatcctgggcagaaatttcccgtgagcatcaaaaggcgtcagtcaggccgcagctctggctccagttcccgaggtttgttgtctcctcacccccagctgccaagcatccccccaacacacactgatgggcccagcggtggaggggggggtggggacggggatgggtcacggggccctgacgggtcccgcagttaggctccctgagccctcggcttataaatacaggtcttgctttgtgggtgggtgccagagtcctcatgtggcttggaggaaatctttatttctcaaattaaaataaaattgcagcgagagtt

SEQ ID NO: 277178 - DNA, 3549 bp, Homo sapiens
  misc_feature (1)..(1): n is a, c, g, or t
ngaggcccaagacccgcgggcttgcggaccggacgcaggcggcagatttgcagcccgggatgcgccagggaacagcctgcgcccccctccctcctctccgcccgctggccgggccaactccggcttctgccgcgcgtgcctggctcggagctccgctgcggaaaacccgagcgcgggcggctccccgcctcgccgcccgggaaaatccgggggtggccgccagggatctccaagcggcctgggctgggcggccggagcttccctcccggatttgcgccccgaacctggcgccctgaagctagaggcccgtcggtccagtccttgcctcccatcttctctccgcagagcgcccagacgacggcgagatgacggccgggagccccgaagaatgcggggaggtgcggaggagccccgagggccgcgtctctcgcttgggccgccgcctgggccgccgccggcgcccgcgctccccgcccgagcctctgcgggtgcgggcgcggctgcggctgcgctcgccgtcgggggcgttcgcggcgctgggggcgctcgtggtactggtgggtatgggcattgcagtggccggctactggccgcaccgggccggggccccagggtcccgggccgccaatgccagctcgccccagatgagcgagctgcgacgcgagggtcgcggcgggggccgggctcacggcccgcacgagcggctgcggctcctcgggccggtgatcatgggcgtcggcctgttcgtgttcatctgcgccaacacactgctgtatgagaaccgagacttggagacgcgacggctccgccagggggtgctgcgggcccaggcgctccggccccccgacggcccgggctgggactgcgccctccttcccagccccggccctaggagtccccgagccgtaggctgcgcagagccagaaatctgggacccgtccccgcgtcggggtacttcacccgtcccgtcagtgcggagtctgcgttcagagcccgctaatcctcgcttggggttacctgccttgctcaacagctacccgctgaagggccccgggctgcccccaccctggggtccacggacgcagactggccatgtgatcatcaccgtgcagccgtctggctcctgcattgaacattccaagtctctggatctgggccttggggagctcctccttggggccccagcagctcgggactgtgctcaccgaagctggccacggctggaccgcctcagtcttgggggctatgccaaattgggaggaggaggggacttgggggcccgggtctgaagagaggggagacagcctgctctgaggctgcagcatggaccatgctaataggaccaaaggaccaggagtcccaacgtctaatagatgtttcagtcacatcccaggctggggatggatgctctgaccacagcagctgtgaagggcatcctgacctgcatgcgggcagagaaatgccagctgcaccagggctcagtgagctggagagggtgcgtttcactgtggggtgtggaggactcgcctcaggaatttcttcagcctctgtaagtggccttagccctaacagggctggaggtccaggccagggtgactgggagatgtacccagtgtcttggcaaacccaagaaagtggtgggcaagggcccctaagactgggaggtaggttgggatgttacaggctggggcaggctccctccaaggcggcactggtgatggagtgtggggcctctgggaagatggaccacgggatgagactctccactgccatctgggacggggactgagccttgaactcctaccacctcaatccctttcttccctcagccatctggggtatatccctctagagctacactactgccaatgccttcatactgagttctgggcccctctgcaaataagtctgagaagccccttctctccttcctttatcgtggcctatgctgcagaatctcactgcagctggcaaaaggcattggccagctctcagaaatccctttactcaacgttgaagctgcattttggtcaatgtgggtaacttactttagaaaatgacttgagtttaggtctcccccacccatatttaatttttcccaagttgctggtagaagagaaatttaaaagtggatcaatcctcacagagagagttctttttgttgttgtttattgaaaaaaatgcaatacaagaagcaagaccaaacagatatctaaacactacaaccacttctactacgaaaggccaaaacagcagacttgattgtgacatcaggtgacctagtaatcagctgtgtattctagctggtgcctctaccagcttcccatgtgaccttgaacatgtcattgaatgctcgctaggcctctgtttctttatctgtgaaatgggcttgatattcctcctctaccccaaccgatagtgcagaatgaaaagtaactgaaagtccttcctccagggcaccatagtgtctgggtgaaaagtagaatataaactcggtagacttctggtcccttcattggtcatggaatggaccagtgcttgcttcattgagcaacagttctgttgttcagaattcctggatttcacctcacttctgctctccctgcaggtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacacaataaagacacacaaggacgtctgcgcagcaagaaaagaatctcagttgccaagcagattgatatcacacagactcaaagcaaaggcatgtggaacttctatatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggc

SEQ ID NO: 277179 - DNA, 501 bp, Homo sapiens
aagttaccacttcccaacttatcctatgagagtcaccacagccaccctccattgcagagaattgccccacacatctgctgcgcacccatggactcgtgacgatgactgaggttttgtggaagacgttgacccgcacaacaggtccatacttcttagccctggaaaccaaagtgacccgaaggaaactgtcaaccacctgaggtatgaccatcaccaaccccgcccagctgagaaaccgatgtttcccgtcccagaaggtgctcaatgcatgctaccaaaagagtgctgtcctggggcccaggagccctgggggcaaggctctgccctgttgctcacttgccgagtcatgtcccccagcaggcctcagtttccacagccatggaatagggttggaaacactccttctttgattgtcccaaaaggttgtcctgggaatcaaatgattcgcatctttgaaagtactttgaaaaatgtaaaaaagtgacacaccaaacaatgact

SEQ ID NO: 277180 - DNA, 631 bp, Homo sapiens
gagactaggaaggcggagggaggctgctattggcagggcctcagtggagacctcccggggtcccgggacgcagacggacgggcctgaatcgctcgccttggtgaaatgggatccagcgctgccaactgcggcaactgcggttaaaggagacgaccccgtgcagcaggaggaggttatttagaataaggaagaatgcgccgggctcattggtcgctacaggggcataaattttttctaggattccagagtatggctgctccagtcccagattcggctcgacttacagacctcagcgcaggacgtggacgccctgcaaaggaggacatttcagcggacggcagagaatacagatttatgccagcgccctgcggaaggagcctctggcgggtcatctccatttatgggagatcgcagagcggttccctctcaggatcttcaccttcaggattactgccattgactgctgaaacaaagagagaatttaacaacttctgagagatatcacaacaccaggcaggaaaaaacaagtcaggtttcttatgccacagccaccttgaacgtcaatctggggagtggcggatactgccgtcgcactccttttccatacttattgagggtgggatacataact

SEQ ID NO: 277181 - DNA, 784 bp, Homo sapiens
aggttaatgatgagatcataagaatagggccttaatccaatccaggactggtgtccttataagaagaccagagaacttgctctctttctctctctctccatgtgaacaaagaaaagaacatgtgaagacacagcgagaaggcggctgactgcaagccaggaagacagccctcaccagaaaccaaattttggggtaccttgatcttggacttccagcttccagaactgtgagaaaataaatttctgttgcttaagccacccagtcggtggtattttgttatgacagcccatgagaatgcatcatatctcaatgatatcttgggtaggtgtgacaattatgcagtttcttcaggtaaaatttataaacagcccattgccacagattttgggacattacagcaacaaaaacaacaaataataaatcaaacttagaataaagactagaatgaaataagacagaagaaaatatcagaagtgaaatttcactaaataaagggctcacagaaaagaaatttaatcagcaaaatatggtcatcactctttagagatgtctaaaaattagttgtgagactttcttcaactaaattggaggaagggcaatttctccccaattccacattgtgtcagcatgctactcctaatatgttttctttggaaaatgaatgcaagaccacaatatgaatacactgagctccatccatccattcattcatccatccatccatccaaccataccatccatccatccaaccatcatcaatccatctctcattcattcactcagt

SEQ ID NO: 277182 - DNA, 337 bp, Homo sapiens
aggttaatgatgagatcataagaatagggccttaatccaatccaggactggtgtccttataagaagaccagagaacttgctctctttctctctctctccatgtgaacaaagaaaagaacatgtgaagacacagcgagaaggcggctgactgcaagccaggaagacagccctcaccagaaaccaaattttggggtaccttgatcttggacttccagcttccagaactgtgagaaaataaatttctgttgcttaagccacccagtcggtggtattttgtcacacctacccaagatatcattgagatatgatgcattctcatgggctgtcataacaaaat

SEQ ID NO: 277183 - DNA, 2140 bp, Homo sapiens
ggatccctgcgggttcgcgagggtgggacgggaacgcgggctggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccgagcttctcggccccgccgacccgtgacaggacgggagtggccccacctgtgggcggctggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccgcgggagctggggcccagcatggccccggaggaccattaccgccggcttgtgtcagcactgagcgaggccagcacctttgaggaccctcagcgcctctaccacctgggcctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcccggcagcaggagctcctgcggaagcagaacctggcccggctggagctgcccgccgactcctgcggcagaaggagctggagagcgcgcgcccacagctgctggccccgagaccgccctggccccaacgacggcccgaggagctgcagcgtccgcgggccctgctggtgctgaaccacggcgcgggcactgctggccctgccccccaggcccccgggctccggactcccgaacccgttccggacctctgcccgtcgagccccccggaaggggggtccgggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggctctgcaggtggccaggcgcctgggccgagttttctacgtggccagcttccccgtggctctgccactgcagccaccaaccctgcgggccccggagcgagaactcggcacaggagagcagcccttgtcccccacgacggccacgtgcccctatggagggggccacgcccttgccggtcaaacttcacccaagcaggagaatgggaccttggctctacttccaggggcccccgacccttcccagctctgtgtcgaggttgccgggggtagggtggggcacacaaatctccaggagccacactcaacacaatggccct

SEQ ID NO: 277184 - DNA, 2188 bp, Homo sapiens
ggatccctgcgggttcgcgagggtgggacgggaacgcgggctggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccgagcttctcggccccgccgacccgtgacaggacgggagtggccccacctgtgggcggctggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccgcgggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcccggcagcaggagctcctgcggaagcagaacctggcccggctggagctgcccgccgactcctgcggcagaaggagctggagagcgcgcgcccacagctgctggccccgagaccgccctggccccaacgacggcccgaggagctgcagcgtccgcgggccctgctggtgctgaaccacggcgcgggcactgctggccctgccccccaggcccccgggctccggactcccgaacccgttccggacctctgcccgtcgagccccccggaaggggggtccgggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggctctgcaggtggccaggcgcctgggccgagttttctacgtggccagcttccccgtggctctgccactgcagccaccaaccctgcgggccccggagcgagaactcggcacaggagagcagcccttgtcccccacgacggccacgtgcccctatggagggggccacgcccttgccggtcaaacttcacccaagcaggagaatgggaccttggctctacttccaggggcccccgacccttcccagctctgtgtcgaggttgccgggggtagggtggggcacacaaatctccaggagccacactcaacacaatggccct

SEQ ID NO: 277185 - DNA, 1665 bp, Homo sapiens
  misc_feature (18)..(18): n is a, c, g, or t
  misc_feature (40)..(40): n is a, c, g, or t
  misc_feature (43)..(44): n is a, c, g, or t
  misc_feature (55)..(55): n is a, c, g, or t
aaggcatgagattgtcanacgaaaagcccgccgccgtttnatnntcgtagcgccnataacttacggcgttagtacgagctgggtgggaatcggccgaggagctggggcccagcatggccccggaggaccattaccgccggcttgtgtcagcactgagcgaggccagcacctttgaggaccctcagcgcctctaccacctgggcctccccagccacggtgaggacccaccctggcatgatccccctcatcacctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcccggcagcaggagctcctgcggaagcagaacctggcccggctggagctgcccgccgactcctgcggcagaaggagctggagagcgcgcgcccacagctgctggccccgagaccgccctggccccaacgacggcccgaggagctgcagcgtccgcgggccctgctggtgctgaaccacggcgcgggcactgctggccctgccccccaggcccccgggctccggactcccgaacccgttccggacctctgcccgtcgagccccccggaaggggggtccgggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggctctgcaggtggccaggcgcctgggccgagttttctacgtggccagcttccccgtggctctgccactgcagccaccaaccctgcgggccccggagcgagaactcggcacaggagagcagcccttgtcccccacgacggccacgtgcccctatggagggggccacgcccttgccggtcaaacttcacccaagcaggagaatgggaccttggctctacttccaggggcccccgacccttcccagctctgtgtcgaggttgccgggggtagggtggggcacacaaatctccaggagccacactcaacacaatggccct

SEQ ID NO: 277186 - DNA, 1526 bp, Homo sapiens
gcgtaacccggccgctagcgcgggggcgctgggccccgctgggatcgatgcgggcggcctggccggctgggctctgcgggctggcacccggcccggggcgggacccacctccgctttcggccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctcacgtcgccctgggcccccatctcaggccccccttcctgggggtgccctcggctctgtgccagaccccaggctacggcttcctgccccccgcgcaggcggagatgttcgcccggcagcaggagctcctgcggaagcagaacctggcccggctggagctgcccgccgactcctgcggcagaaggagctggagagcgcgcgcccacagctgctggccccgagaccgccctggccccaacgacggcccgaggagctgcagcgtccgcgggccctgctggtgctgaaccacggcgcgggcactgctggccctgccccccaggcccccgggctccggactcccgaacccgttccggacctctgcccgtcgagccccccggaaggggggtccgggccctgcctcagcgcggcccagcgagtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggctctgcaggtggccaggcgcctgggccgagttttctacgtggccagcttccccgtggctctgccactgcagccaccaaccctgcgggccccggagcgagaactcggcacaggagagcagcccttgtcccccacgacggccacgtgcccctatggagggggccacgcccttgccggtcaaacttcacccaagcaggagaatgggaccttggctctacttccaggggcccccgacccttcccagctctgtgtcgaggttgccgggggtagggtggggcacacaaatctccaggagccacactcaacacaatggccct

SEQ ID NO: 277187 - DNA, 1614 bp, Homo sapiens
ggatccctgcgggttcgcgagggtgggacgggaacgcgggctggaagtcgggccgagggaaaagtctgaagacgcttatgtccaaggggatcctgcaggtgcatcctccgatctgcgactgcccgggctgccgaatatcctccccggtgaaccgggggcggctggcagacaagaggacagtcgccctgcctgccgcccggaacctgaagaaggagcgaactcccgagcttctcggccccgccgacccgtgacaggacgggagtggccccacctgtgggcggctggccaggcttgaagcaggaggatggtccgcacatccgtatcatgaagagaagagtccacacccactgggacgtgaacatctctttccgagaggcgtcctgcagccaggacggcaaccttcccaccctcatatccagcgtccaccgcagccgccacctcgttatgcccgagcatcagagccgctgtgaattccagagaggcagcctggagattggcctgcgacccgccggtgacctgttgggcaagaggctgggccgctccccccgtatcagcagcgactgcttttcagagaagagggcacgaagcgaatcgcctcaagaggcgctgctgctgccgcgggagctggggcccagcatggccccggaggaccattaccgccggcttgtgtcagcactgagcgaggccagcacctttgaggaccctcagcgcctctaccacctgggcctccccagccacgatctcctgagggtccggcaggaggtggcggctgcagctctgaggggccccagtggcctggaagcccacctgccctcctccacggcaggtcagcgtcggaagcagggcctggctcagcaccgggagggcgccgccccagctgccgccccgtccttctcggagagggagctgcctcagccgccccccttgctgtcgccgcagaatgcccctccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggctctgcaggtggccaggcgcctgggccgagttttctacgtggccagcttccccgtggctctgccactgcagccaccaaccctgcgggccccggagcgagaactcggcacaggagagcagcccttgtcccccacgacggccacgtgcccctatggagggggccacgcccttgccggtcaaacttcacccaagcaggagaatgggaccttggctctacttccaggggcccccgacccttcccagctctgtgtcgaggttgccgggggtagggtggggcacacaaatctccaggagccacactcaacacaatggccct

SEQ ID NO: 277188 - DNA, 988 bp, Homo sapiens
tacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttattttttaatacaatagctgccgtccaaggagatgacgggggctaggctctgggcacaagatggctcggaagacgagccccccaaagactcggacggagaggaccccgagacggcagctgttgggtgcagggggcccactccgggccaagctccagctggaggggccggcgccgaggggaaggggcttttcccagggtccacactgcccctgggcttcccttatgccgtcagcccctacttccacacaggcgcggtagggggactctccatggatggggaggaggccccagcccctgaggacgtcaccaagtggaccgtggatgacgtctgcagcttcgtggggggcctgtctggctgtggagagtacactcgggtcttcagggagcaggggatcgacggggagaccctgccactgctgacggaggagcacctgctgaccaacatggggctgaagctggggcccgccctcaagatccgggcccaggctctgcaggtggccaggcgcctgggccgagttttctacgtggccagcttccccgtggctctgccactgcagccaccaaccctgcgggccccggagcgagaactcggcacaggagagcagcccttgtcccccacgacggccacgtgcccctatggagggggccacgcccttgccggtcaaacttcacccaagcaggagaatgggaccttggctctacttccaggggcccccgacccttcccagctctgtgtcgaggttgccgggggtagggtggggcacacaaatctccaggagccacactcaacacaatggccct

SEQ ID NO: 277189 - DNA, 250 bp, Homo sapiens
ttctgcctgacactcaaacccaacagatcactgtttttaaaaaatttccgtgagctgcacaaacagctcctcttggctctgctgggctggaggatggagcagcacccgggtcctgaccctccctccctcccccttccaggtcttcagggagcaggggatcgacggggagaccctgccactgctgacggaggagcacctgctgaccaacatggggctgaagctggggcccgccctcaagatccgggcccag

SEQ ID NO: 277190 - DNA, 1376 bp, Homo sapiens
accgcagttgtgccccgccgaccatgcgccgcctcccgcgggccctgctgctgcagctgcgcctcgccctgctggtggccgcgggggccccggaggtgctggtcagcgcgccgcggagcctggtgtgggggcccgggctgcaggcggccgtcgtcctgccggtccgctatttctacctgcaggcggtcaactcggagggccagaacctcactcgctctcccgcaggtgaaacaccattcaaagtcgtagtcaaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggaccagtgtaccatgagtactgtgagtgtccggaagatcctcaggcctggcagaagactctttcttgtccaaccaaggaaccacagattgcaaaagattttgcttcctttcccagcatcaatctccagcaaatgctaaaagaagtccccaaaaggtttggggatgagagaggtgccattgttcattacacgattctcaataaccatgtttaccggagatctttagggaaatacacagacttcaagatgttctctgatgagattttgttatcattgacaagaaaggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggaccta

SEQ ID NO: 277191 - DNA, 243 bp, Homo sapiens
tgacatgatacgactcgagctcggtaccatatatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggaccta

SEQ ID NO: 277192 - DNA, 397 bp, Homo sapiens
gcacgagctcactgacattctactccaagtcggagatgcacatccactccaagtcacacaccgagaccaagccccacaagtgcccacattgctccaagaccttcgccaacagctcctacctggcccagcacatccgtatacactcaggggctaagccctacagttgtaactttgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatacccactcatcacggccatctttgttgtaaccatttctgtgtttataaatgcattatctctgagaa

SEQ ID NO: 277193 - DNA, 1295 bp, Homo sapiens
agtagcccaggccgaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatacccactcatcacggccatctttgttgtaaccatttctgtgtttataaatgcattatctctgagaa

SEQ ID NO: 277194 - DNA, 957 bp, Homo sapiens
gtgaaggaaagccgtgacagaggcccaaggagatggagccaaggcctgtcaaggaagaaaaggacttttcccaccaagacttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatacccactcatcacggccatctttgttgtaaccatttctgtgtttataaatgcattatctctgagaa

SEQ ID NO: 277195 - DNA, 1242 bp, Homo sapiens
agtagcccaggccgaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttcttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatacccactcatcacggccatctttgttgtaaccatttctgtgtttataaatgcattatctctgagaa

SEQ ID NO: 277196 - DNA, 1247 bp, Homo sapiens
agtagcccaggccgaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatacccactcatcacggcca

SEQ ID NO: 277197 - DNA, 1415 bp, Homo sapiens
agtagcccaggccgaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatacccactcatcacggccatctttgttgtaaccatttctgtgtttataaatgcattatctctgagaaaaaaaaaaaaaggccgcggttacaacgccggacctggaaaccttgcgtacccaactaattgcttggagacatcccctttcggcagctggcgaatagcaaagaggcccgcccgatcgtctt

SEQ ID NO: 277198 - DNA, 1114 bp, Homo sapiens
agtagcccaggccgaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagcctccttgcttctactatttaacccccatgatctatttcttcaaa

SEQ ID NO: 277199 - DNA, 1158 bp, Homo sapiens
  misc_feature (16)..(16): n is a, c, g, or t
  misc_feature (23)..(23): n is a, c, g, or t
ccaggctggtacgccncgagtantggatatcgtcgaccaggccgtcgggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatacccactcatcacggccatctttgttgtaaccatttctgtgtttataaatgcattatctctgagaa

SEQ ID NO: 277200 - DNA, 1566 bp, Homo sapiens
agtagcccaggccgaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatacccactcatcacggccatctttgttgtaaccatttctgtgtttataaatgcattatctctgagaattttcatatttgatgttttgtttatttttgtcctttttttccctctctccacccctgtcctctagccacagcatttttctttttgtcttttttttttttttttaaatcatggcagatttcagaggaaaggaaattaaaaaaaaaatcaggaaaccagttgttataaagtaatttaaaaatgaagaaaaaaagaaaaaaacttatgtacaaaccaaggggtgtttttagaacattgtatagaaataaattcatgtaaaaggatcagaggcag

SEQ ID NO: 277201 - DNA, 780 bp, Homo sapiens
cctcgctttgcttcactcgcgccccttccggcttcccttccttctcactctcttgccgtagctgcgccgccaccggggcctcacgtgacactagactctcccggcacgtgacgtgagaaaggggccgggctggggcgggataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaaccgcgccccgcgggcaaggaattgcgcctgcgtctgaggggagggtgcgccagtgaagagccctactgcgcatgtgtgactagaagggtagtccctgactgtgaagggaaatctggccccctcctgtcggggaggcgtcctgtaggcgtgcgcccaatggggctgtcagtattggcatttctccccactccccgcaggctctatgcgctattcctacagtacgctgggaggctttgggcaagttacttacccaacctggggtttagtgtcctcagcctatcaaaagagggccttagattcattgatttctacgatctcctccatttcaaacactaactagttcagtaaaactttacagcagtgtttcagatat

SEQ ID NO: 277202 - DNA, 3117 bp, Homo sapiens
cctcgctttgcttcactcgcgccccttccggcttcccttccttctcactctcttgccgtagctgcgccgccaccggggcctcacgtgacactagactctcccggcacgtgacgtgagaaaggggccgggctggggcgggataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaaccta

SEQ ID NO: 277203 - DNA, 1795 bp, Homo sapiens
cctcgctttgcttcactcgcgccccttccggcttcccttccttctcactctcttgccgtagctgcgccgccaccggggcctcacgtgacactagactctcccggcacgtgacgtgagaaaggggccgggctggggcgggataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttc

SEQ ID NO: 277204 - DNA, 3413 bp, Homo sapiens
cctcgctttgcttcactcgcgccccttccggcttcccttccttctcactctcttgccgtagctgcgccgccaccggggcctcacgtgacactagactctcccggcacgtgacgtgagaaaggggccgggctggggcgggataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaacctaaaaaaaaaataatgacaacaacccacgcaacgatatagacacaacgactacgcagcacaaacaaacgaacaggaggggggcgcaccaaagaaaaatcccccgggggccaaaatttcacgtctccccccgctctttcttgcacaaagaggcgcccaaaaggaggggcgtctttaataacacagagacagcggccgcgttaaaaacgtgccgggtcggggaaaacgcgacacggggcacctatcggaacaagaaccccttctgtcgcgggacaaatgtcgcaacaacccccaacagaa

SEQ ID NO: 277205 - DNA, 2808 bp, Homo sapiens
aggtggaacgagagacttggaaaagaaagggacatagacaaagtatagagaaagaaaaaagggggcccaggggaccggcgctcagcacacggaggatctctgccagcctctgagttccattagtatttattgatcattattgggtgtttctcggagagtgggatgtggcaggatcataggatagtagtggagagagggtcaacaggtaaacacgtgaacaaaggtctctgcatcataaacaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaaccta

SEQ ID NO: 277206 - DNA, 3083 bp, Homo sapiens
cctcgctttgcttcactcgcgccccttccggcttcccttccttctcactctcttgccgtagctgcgccgccaccggggcctcacgtgacactagactctcccggcacgtgacgtgagaaaggggccgggctggggcgggataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaaccta

SEQ ID NO: 277207 - DNA, 2645 bp, Homo sapiens
cctcgctttgcttcactcgcgccccttccggcttcccttccttctcactctcttgccgtagctgcgccgccaccggggcctcacgtgacactagactctcccggcacgtgacgtgagaaaggggccgggctggggcgggataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaaccta

SEQ ID NO: 277208 - DNA, 2497 bp, Homo sapiens
cctcgctttgcttcactcgcgccccttccggcttcccttccttctcactctcttgccgtagctgcgccgccaccggggcctcacgtgacactagactctcccggcacgtgacgtgagaaaggggccgggctggggcgggataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaaccta

SEQ ID NO: 277209 - DNA, 2270 bp, Homo sapiens
aggtggaacgagagacttggaaaagaaagggacatagacaaagtatagagaaagaaaaaagggggcccaggggaccggcgctcagcacacggaggatctctgccagcctctgagttccattagtatttattgatcattattgggtgtttctcggagagtgggatgtggcaggatcataggatagtagtggagagagggtcaacaggtaaacacgtgaacaaaggtctctgcatcataaacaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaacaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaaccta

SEQ ID NO: 277210 - DNA, 1347 bp, Homo sapiens
accatttagggagtagctagatatatggttccatccaagccttgggtactctaagccttggatggaaccatttagggagtagctagatatacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttatacatttctgctctcctttctcctaagtttcatgcagatgaatataaggtaatatactattatataattcatttgtgatatccacaataatatgactggcaagaattggtggaaatttgtaattaaaataattattaaaccta

SEQ ID NO: 277211 - DNA, 1728 bp, Homo sapiens
cctcgctttgcttcactcgcgccccttccggcttcccttccttctcactctcttgccgtagctgcgccgccaccggggcctcacgtgacactagactctcccggcacgtgacgtgagaaaggggccgggctggggcgggataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtgggtaagtttgtgagggtgttcctttttgcttgttcttcccaaatttaaagcatagttaattcaaggaaaaaaataaaatcagtactgatttgtcaaaaa

SEQ ID NO: 277212 - DNA, 960 bp, Homo sapiens
agcggagttgagaaactgcaaggaacacaaaagactcaaacaacagagttcgagggtctacttgctaactctgggacctatggcaaaacccaaatgaaccaccaactggtctcactctgtcatccaggctggagcggtgccatcacagctcactgcagcctggacctcccagactcaagtgatcctcccaccacagcctcccaagtagccaggactacaggtgagtgctctgctaagctctgcaacaagttccaagctagtagtggccagctactcagctttctcaggaaactcaccttctctccttggagtgatgggactgagtcccgcaaactgtgaaagctgtctttgatgtggtccctacgttttcgttccagtgcattatgatgagcccgtttgtcagcctagaagaatgggagaaagaacacattaggaatgtcactccttttgcttggtacaaggtgggtggggtacagcctggaagtacacgctgtcagcactgtccctggcgagtggactgggaaggatttctcgaggtgggcagttaggagtctccagaattaggctctgctaaagggggagaaaggggtgagcaacgcttgcgacaggaacatccaaagtagctcgatgcatccagctcatgcataagtaaaataaaagttattcagggggacaaagtgtgactctcctgtaacatcagtggtcccccccaacttgcttatgtgacagaagagccaccagtctgtggttaggaagtgactagagaaagctccagtggccccttcttaagatgtgatcacctccactgtaagagattccccagatgggtgtccaggggaagaaagagttaagtcactggtgcttctttaatgtgaaaccatcaccatgagtcccaagcccactaaaaggcactagtttaagaccttctcaccaaatcatacaacagaagctaaaacctct

SEQ ID NO: 277213 - DNA, 3568 bp, Homo sapiens
ggaagtcgatacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagacaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcagataatggcagctttaaactcccagactgccgtgcagttccagcagtatgcagcccaacagtatccagggaactacgaacagcagcaaattctcatccgccagttgcaggagcaacactatcagcagtacatgcagcagttgtatcaagtccagcttgcacagcaacaggcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaagaatctcttccagtaatagcagctccatccatgtggacacgacctcagatcaaagacttcaaagagaagattcagcaggatgcagattccgtgattacagtgggccgaggagaagtggtcactgttcgagtacccacccatgaagaaggatcatatctcttttgggaatttgccacagacaattatgacattgggtttggggtgtattttgaatggacagactctccaaacactgctgtcagcgtgcatgtcagtgagtccagcgatgacgacgaggaggaagaagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaa

SEQ ID NO: 277214 - DNA, 912 bp, Homo sapiens
ggaagtcgatacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagacaaaaaaaggtgaagtttgagggcatggaatactttattgctgcgcagcccagtgtactgatgcttttgttttgtagagtgtctgttctagttctagatcaggtgtcttgctttccttggatccccatttcttgtggcaattgttcaaacttcctgatgtgaacaggtacttgtattataagttttggggggagggaggactgcttcctactggccgtgcctttaaaaggaacctcccatccatcatggcagccttccttttgttttattacactaagtttctgaataagccccacc

SEQ ID NO: 277215 - DNA, 3919 bp, Homo sapiens
ggaagtcgatacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagacaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcagataatggcagctttaaactcccagactgccgtgcagttccagcagtatgcagcccaacagtatccagggaactacgaacagcagcaaattctcatccgccagttgcaggagcaacactatcagcagtacatgcagcagttgtatcaagtccagcttgcacagcaacaggcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaagaatctcttccagtaatagcagctccatccatgtggacacgacctcagatcaaagacttcaaagagaagattcagcaggatgcagattccgtgattacagtgggccgaggagaagtggtcactgttcgagtacccacccatgaagaaggatcatatctcttttgggaatttgccacagacaattatgacattgggtttggggtgtattttgaatggacagactctccaaacactgctgtcagcgtgcatgtcagtgagtccagcgatgacgacgaggaggaagaagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaaaaaaaaaagaaagaaaacagaaaagcaagaacaaaaacaaaaagaaaaacaacaagaaaaaaaaaacaatcgacgaccaccgagaaacaccgcgcggggcacaagagacgccaggaaacaagaagttcaaaaagagtaagagagaggggcggagagcggcaaaaaagaagactgagacaaagacgaagaaacgagctcgcagcaccacagacgaccgtgtatagaaaaggggggggaggcccccaccgaaaaaggacgcgggggggaacacaagcgctgcgtaaaaacccacaaagggtgcgggggaaacagcgcaacaacacagcgaggccacaagcggcacgtaaaaag

SEQ ID NO: 277216 - DNA, 3393 bp, Homo sapiens
ggaagtcgatacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagacaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaagaatctcttccagtaatagcagctccatccatgtggacacgacctcagatcaaagacttcaaagagaagattcagcaggatgcagattccgtgattacagtgggccgaggagaagtggtcactgttcgagtacccacccatgaagaaggatcatatctcttttgggaatttgccacagacaattatgacattgggtttggggtgtattttgaatggacagactctccaaacactgctgtcagcgtgcatgtcagtgagtccagcgatgacgacgaggaggaagaagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaa

SEQ ID NO: 277217 - DNA, 3022 bp, Homo sapiens
  misc_feature (11)..(11): n is a, c, g, or t
ggcccaagganaagtggtcactgttcgagtacccacccatgaagaaggatcatatctcttttgggaatttgccacagagaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcagataatggcagctttaaactcccagactgccgtgcagttccagcagtatgcagcccaacagtatccagggaactacgaacagcagcaaattctcatccgccagttgcaggagcaacactatcagcagtacatgcagcagttgtatcaagtccagcttgcacagcaacaggcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaagaatctcttccagtaatagcagctccatccatgtggacacgacctcagatcaaagacttcaaagagaagattcagcaggatgcagattccgtgattacagtgggccgaggagaagtggtcactgttcgagtacccacccatgaagaaggatcatatctcttttgggaatttgccacagacaattatgacattgggtttggggtgtattttgaatggacagactctccaaacactgctgtcagcgtgcatgtcagtgagtccagcgatgacgacgaggaggaagaagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaa

SEQ ID NO: 277218 - DNA, 3268 bp, Homo sapiens
ggaagtcgatacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagacaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcagataatggcagctttaaactcccagactgccgtgcagttccagcagtatgcagcccaacagtatccagggaactacgaacagcagcaaattctcatccgccagttgcaggagcaacactatcagcagtacatgcagcagttgtatcaagtccagcttgcacagcaacaggcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaagaatctcttccagtaatagcagctccatccatgtggacacgacctcagatcaaagacttcaaagagaagattcagcaggatgcagattccgtgattacagtgggccgaggagaagtggtcactgttcgagtacccacccatgaagaaggatcatatctcttttgggaatttgccacagacaattatgacattgggtttggggtgtattttgaatggacagactctccaaacactgctgtcagcgtgcatgtcagtgagtccagcgatgacgacgaggaggaagaagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaa

SEQ ID NO: 277219 - DNA, 2252 bp, Homo sapiens
gttaaggcatatcgtcgacccacgcgctccggtattttgaatggacagactctccaaacactgctgtcagcgtgcatgtcagtgagtccagcgatgacgacgaggaggaagaagaaaacatcggttgtgaagagaaagccaaaaagaatgccaacaagcctttgctggatgagattgtgcctgtgtaccgacgggactgtcatgaggaggtgtatgctggcagccatcaatatccagggagaggagtctatctcctcaagtttgacaactcctactctttgtggcggtcaaaatcagtctactacagagtctattatactagataaaaatgttgttacaaagtctggagtctagggttgggcagaagatgacatttaatttggaaatttctttttacttttgtggagcattagagtcacagtttaccttattgatattggtctgatggtttgtgaactcttgctgggaatcaaaatttccttgagactctttagcattcatactttggggttaaaggagattcctcagactcatccagcccttgggtgctgaccagcagagtcactagtggatgctgaagttacatgagctacatgttaaatatttaaagtctccaaaataaaacaccccaacgttgaccttacccggctgatggttagccccttgctgcctgctccatgtgtcttatgagagcccgtagttacagtgtcctctaatttgaaatccataagttaacaagtctatatcaggtgcagctggctttgattaaaggccatttttaaaacttaaaaactcaacacctcacagattataatagaaaaagaaatggcctcagtttgatctcgttcagaatgacccagattgtttctgctttgggtgcagctgtttagttcagagttatattacagagaattattttctgagataatcttaaactagaatgttcaaaactaattgataattgaagtatcaagatacgtagaacacctcagagatttttcttcaggaacttccacaaactttgaatccttgtatctttatttggtattcatactactagtagcaaaatacaggttttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaa

SEQ ID NO: 277220 - DNA, 1345 bp, Homo sapiens
ctatagactaacttggaagctactcgacgcatcacgctacgtaacgaccgtcgagcaggatgtttatctatcatgagaaacgttcgcgacaacacgtctagtaactccattgatagttctctatatattgggtgattcattacgtacatagatatgcaaaatacaggttttttgttttgttttgttttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaa

SEQ ID NO: 277221 - DNA, 1341 bp, Homo sapiens
ggaagtcgatacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagacaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcagataatggcagctttaaactcccagactgccgtgcagttccagcagtatgcagcccaacagtatccagggaactacgaacagcagcaaattctcatccgccagttgcaggagcaacactatcagcagtacatgcagcagttgtatcaagtccagcttgcacagcaacaggcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaagaatctcttccagtaatagcagctccatccatgtggacacgacctcagatcaaagacttcaaagagaagattcagcaggatgcagattccgtgattacagtgggccgaggagaagtggtcactgttcgagtacccacccatgaagaaggatcatatctctttataattcattggccctagggagatcaggtcggtgt

SEQ ID NO: 277222 - DNA, 1557 bp, Homo sapiens
ggaagtcgatacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagacaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcagataatggcagctttaaactcccagactgccgtgcagttccagcagtatgcagcccaacagtatccagggaactacgaacagcagcaaattctcatccgccagttgcaggagcaacactatcagcagtacatgcagcagttgtatcaagtccagcttgcacagcaacaggcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaaggtaggttttgcatatgtgtttgtccagatgtcataattccaaatctgtgaaaggcaaaagtcatgaagtcaggttataattagcttttgagaacaattacatatttgtgagagttgaacatttttttactctttttagtctgaatctaatgctctggtgactcatagaccagtgtagaagagcaaatcagatgtctttggacacttttaagacaaaagttatgttttgtcatatatatatatataaattatctattgctgcataacaaattacaggctgggcgcagtggctcatacctgtaatcccagcactctgggaggctgaggcaggaagatcacttgagcccaagagtttgaggctgcagtgaactatgattccgcctgcctgggtgacaaagcaagactgtctctca

SEQ ID NO: 277223 - DNA, 1382 bp, Homo sapiens
ggaagtcgatacgtggctgccgtctgtccccgctgaggaggtgcagcagccggagatggcggcggtgctgaacgcagagcgactcgaggtgtccgtcgacggcctcacgctcagcccggacccggaggagcggcctggggcggagggcgccccgctgctgccgccaccgctgccaccgccctcgccacctggatccggtcgcggcccgggcgcctcaggggagcagcccgagcccggggaggcggcggctgggggcgcggcggaggaggcgcggcggctggagcagcgctggggtttcggcctggaggagttgtacggcctggcactgcgcttcttcaaagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggagagaatgggcagccctgggaaacatgtctaaagaggatgccatggtggagtttgtcaagctcttaaataggtgttgccatctcttttcaacatatgttgcgtcccacaaaatagagaaggaagagcaagacaaaaaaaggaaggaggaagaggagcgaaggcggcgtgaagaggaagaaagagaacgtctgcaaaaggaggaagagaaacgtaggagagaagaagaggaaaggcttcgacgggaggaagaggaaaggagacggatagaagaagaaaggcttcggttggagcagcaaaagcagcattacagaaacaacaggaagtagtagtggctgggtcttccttgcctacatcatcaaaagtgaatgcaactgtaccaagtaatatgatgtcagttaatggacaggccaaaacacacactgacagctccgaaaaagaactggaaccagaagctgcagaagaagccctggagaatggaccaaaaggtaggttttgcatatgtgtttgtccagatgtcataattccaaatctgtgaaaggcaaaagtcatgaagtcaggttataattagcttttgagaacaattacatatttgtgagagttgaacatttttttactctttttagtctgaatctaatgctctggtgactcatagaccagtgtagaagagcaaatcagatgtctttggacacttttaagacaaaagttatgttttgtcatatatatatatataaattatctattgctgcataacaaattacaggctgggcgcagtggctcatacctgtaatcccagcactctgggaggctgaggcaggaagatcacttgagcccaagagtttgaggctgcagtgaactatgattccgcctgcctgggtgacaaagcaagactgtctctca

SEQ ID NO: 277224 - DNA, 643 bp, Homo sapiens
gtgagtccagcgatgacgacgaggaggaagaaggtagaacccttggtccatattcagtagctgctgggttgtgtgttggcagaaatggtacatagttcaggtgtcacccagccttatgcttcctgactaacacttcatggttagggaacactttcttcattagtgggaccttgggctgaaaatgttatgaggccaggctcctgtaggggactggggcctaaacctgaatttttctgaatgccaggaaaatctatttggcaatttgctattttactcctttctgaatactattttacttctaaccgtgtgtgttgaaaagccaaatatgcaagattacttcaaaaaaaatttttttttttttgagacagggtctcactctgtcacccaggctggagtgcagtggcatgatctctgctcacagtagtctcggcctcttaggttcaagcgattctcctgcctcagcctcctgagtagctgggattacaggcacgcaccactgtgccggctaattttttgtatttttagtagagacgaggtttcaccatgttggtcaggctggtctcgaactcctgaccttgtgatccacccgcctcggcctcccaaagtgctgggattacaggcgtgagccacagcacccgaccca

SEQ ID NO: 277225 - DNA, 475 bp, Homo sapiens
gggcaacagagtgagactctctctaaaaataaaaaaattttttaaaagtagtaattgaaataaaaatttcactattagtgtttgtgtctattacaggcagtttgtgacatgctttgtagcaaagctttagtatataatgctgaaaattatgtattttgcctgtgctaattgttttctttgtgtttctttttcttatagaaaaagatggcaaagcatttcatccaacttatgaagaaaaattgaagcttgtggcactgcataagcaagttcttatgggcccatataatccagacacttgtcctgaggttggattctttgatgtgttggggaatgacaggaggtaacagtgtttttctgtatagtgaatttaatgaggataatgttggcaaagggtacaatgtgtattggttaaggtgtaagtagctggttcattagcttaggataagaactgaacatttttgcttgcagcttctgg

SEQ ID NO: 277226 - DNA, 643 bp, Homo sapiens
acctttcaaagtcacagttccaatggtttttgtaaggtcaaccagaggcagagaacacaatcatggtggcttaccgtcaaaatcatgacaagttgtcaacctaatgccttctgtcaaacataaccaccacccactctgcttctgtcctgtgaggaatgacgggaagtagggagtcaagacttgatattaatgtagatcgcatgtgacacttgcgtggccagcagacaaggccccccacccatgcccaggcttggacaaaatggtggctatgttttctgtgccaaacctcctcatctctgccatgtctagcctagaccttgaagtgtctgatcctccccggacatggaggaaccactggcccagcagcagcaccaacactaggctgcaccactgtgcgtgttttccgggggtgcgacacttctcctgagggtgaccccaatgagaccacacccatgaaggtgtgtggcgcaggtcatagtgcgcccgatgcaactggtgtcctggaggagctgccagtaacacatgggagtctgggggtgagccagctggagggagtccaggtgcgccaaagtgaaggggacggaggtgcatctgggtccaccacgggtgtggggactgcttcattggcaccttctggttgggg

SEQ ID NO: 277227 - DNA, 1067 bp, Homo sapiens
aaggatccagaatgggacggatttggctcctccaggaagaaagcaaaacaaatgcaggtcgcgaacactttacattgcaggaagctgctcttccagtggccgcggctgggtccttccacaccacctctctgtcctaggccttcgtcccggttcagccctcacggattctaggctagcggtcaacaaccgcatccctccggaacctggaaactctaggtccgagatctcggtgaagaatgaaaggcacagcgccgctcaacccaggcttcaggcctgccccgctggtcccgtcccttccctgtgggatggaactctgtgggaatcgctccttattctgatggttcactcattcagatgtccttgatatttggggatatttctaaaacagctggggagaaaaatggactgcgaggctccggtgttggacgtgaaattggcagtgagacatccgcctctaagcccagggaaaagcttaaattgtggttctctgtctctagcaccgtgatctttgaaatgcgttattgattttcttctttcttctgggaaatgcaatgcaggtgaacttgtaagtgttgaatcctccctctcctcactgttcaatcagactgaggcctacttcctttctgataagaaatatggaactgccattgctcagtaggaaaatgtcctttctacaagcattcatatttcaataaaaatctgcactttgtgagttgagccccctcaaagagacctacagaccctgccatgagcatctccatccacactcatcatttcccattttcaccacttctgctcctgtgcaaaccagtactatccttttctgggggatcctaggcagaagcgatggcaggacaaaggcagagaaggcactgccaggtcctgcatgccagtaaaactactcatgtcagctgttctgcaggatcccatgagaagatggcctaattggattatttcagcaagctaagtaatttgaagagagaggctaagccaatgtagtactagagctacactggccttctttggcttaacatttgtctggaattataatttcctcaatctaagaa

SEQ ID NO: 277228 - DNA, 1144 bp, Homo sapiens
aaggatccagaatgggacggatttggctcctccaggaagaaagcaaaacaaatgcaggtcgcgaacactttacattgcaggaagctgctcttccagtggccgcggctgggtccttccacaccacctctctgtcctaggccttcgtcccggttcagccctcacggattctaggctagcggtcaacaaccgcatccctccggaacctggaaactctaggtccgagatctcggtgaagaatgaaaggcacagcgccgctcaacccaggcttcaggcctgccccgctggtcccgtcccttccctgtgggatggaactctgtgggaatcgctccttattctgatggttcactcattcagatgtccttgatatttggggatatttctaaaacagctggggagaaaaatggactgcgaggctccggtgttggacgtgaaattggcagtgagacatccgcctctaagcccagggaaaagcttaaattgtggttctctgtctctagcaccgtgatctttgaaatgcgttattgattttcttctttcttctgggaaatgcaatgcaggtgaacttgtaagtgttgaatcctccctctcctcactgttcaatcagactgaggcctacttcctttctgataagaaatatggaactgccattgctcagtaggaaaatgtcctttctacaagcattcatatttcaataaaaatctgcactttgtgagttgagccccctcaaagagacctacagaccctgccatgagcatctccatccacactcatcatttcccattttcaccacttctgctcctgtgcaaaccagtactatccttttctgggggatcctaggcagaagcgatggcaggacaaaggcagagaaggcactgccaggtcctgcatgccagtaaaactactcatgtcagctgttctgcaggatcccatgagaaggtgagtcaccagaaaatgcagtttccacatcctgatgatttcatctccctaccccaactgatcaatttctccaattttccagcctctcaccctccacaatccccttaaaaactgtagcccagaactctctggaatgatgaatttgaaggtttgctcctgtctcctcactcagaagcctgtaatcattaaactctttctctgatgcaaa

SEQ ID NO: 277229 - DNA, 1260 bp, Homo sapiens
aaggatccagaatgggacggatttggctcctccaggaagaaagcaaaacaaatgcaggtcgcgaacactttacattgcaggaagctgctcttccagtggccgcggctgggtccttccacaccacctctctgtcctaggccttcgtcccggttcagccctcacggattctaggctagcggtcaacaaccgcatccctccggaacctggaaactctaggtccgagatctcggtgaagaatgaaaggcacagcgccgctcaacccaggcttcaggcctgccccgctggtcccgtcccttccctgtgggatggaactctgtgggaatcgctccttattctgatggttcactcattcagatgtccttgatatttggggatatttctaaaacagctggggagaaaaatggactgcgaggctccggtgttggacgtgaaattggcagtgagacatccgcctctaagcccagggaaaagcttaaattgtggttctctgtctctagcaccgtgatctttgaaatgcgttattgattttcttctttcttctgggaaatgcaatgcaggtgaacttgtaagtgttgaatcctccctctcctcactgttcaatcagactgaggcctacttcctttctgataagaaatatggaactgccattgctcagtaggaaaatgtcctttctacaagcattcatatttcaataaaaatctgcactttgtgagttgagccccctcaaagagacctacagaccctgccatgagcatctccatccacactcatcatttcccattttcaccacttctgctcctgtgcaaaccagtactatccttttctgggggatcctaggcagaagcgatggcaggacaaaggcagagaaggcactgccaggtcctgcatgccagtaaaactactcatgtcagctgttctgcaggatcccatgagaaggtgagtcaccagaaaatgcagtttccacatcctgatgatttcatctccctaccccaactgatcaatttctccaattttccagcctctcaccctccacaatccccttaaaaactgtagcccagaactctctggaatgatgaatttgaaggtttgctcctgtctcctcactcagaagcctgtaatcattaaactctttctctgatgcaaaaaaaaacaaaaaaacaacacacaaaaacaaaacaacacaaaacacacaacacacaaaaaaaaacaaacacacaagagagggggggcgccgcccccccagacacacgactctccccg

SEQ ID NO: 277230 - DNA, 890 bp, Homo sapiens
aaggatccagaatgggacggatttggctcctccaggaagaaagcaaaacaaatgcaggtcgcgaacactttacattgcaggaagctgctcttccagtggccgcggctgggtccttccacaccacctctctgtcctaggccttcgtcccggttcagccctcacggattctaggctagcggtcaacaaccgcatccctccggaacctggaaactctaggtccgagatctcggtgaagaatgaaaggcacagcgccgctcaacccaggcttcaggcctgccccgctggtcccgtcccttccctgtgggatggaactctgtgggaatcgctccttattctgatggttcactcattcagatgtccttgatatttggggatatttctaaaacagctggggagaaaaatggactgcgaggctccggtgttggacgtgaaattggcagtgagacatccgcctctaagcccagggaaaagcttaaattgtggttctctgtctctagcaccgtgatctttgaaatgcgttattgattttcttctttcttctgggaaatgcaatgcagtactatccttttctgggggatcctaggcagaagcgatggcaggacaaaggcagagaaggcactgccaggtcctgcatgccagtaaaactactcatgtcagctgttctgcaggatcccatgagaaggtgagtcaccagaaaatgcagtttccacatcctgatgatttcatctccctaccccaactgatcaatttctccaattttccagcctctcaccctccacaatccccttaaaaactgtagcccagaactctctggaatgatgaatttgaaggtttgctcctgtctcctcactcagaagcctgtaatcattaaactctttctctgatgcaaa

SEQ ID NO: 277231 - DNA, 359 bp, Homo sapiens
cgaaacttcttccatcgcatttgagagaactcagggtttttgctgcagctcaggtgggaatgcagtgtcatgctcttggcaacctggacctcccaggctcaagggatcctctccgtcagcctccagagtagctggtgatcctcccccctcagcctacagagtagctgggaatacaagtcctgcatgccagtaaaactactcatgtcagctgttctgcaggatcccatgagaagcctctcaccctccacaatccccttaaaaactgtagcccagaactctctggaatgatgaatttgaaggtttgctcctgtctcctcactcagaagcctgtaatcattaaactctttctctgatgcaaa

SEQ ID NO: 277232 - DNA, 439 bp, Homo sapiens
attattgtaactttatttatttatttatttatttacaagaggatcatccaatggaaggtctcagaggaagtttcagggcccaggattccaaaggcgggccgtggacacagtctcagggcgtctgtccccaagcgcatgccatctgcagccagcagtcttggaactttggttggtggcaccaggggacagcagtaggctgacactctcaaaggtcttctcggatggaagtctccggctccagtcgtctgtccactaagcgagaggcgagttgcgagggaggctgcgggggcgggcgggcgtatgttgagaccctatgcagcctcctgctctcccgagggctcctgcggctcctcctgaattgcctgcgccggatccagagcaggcgactctgcgccccgcctccaggtactctgaggcttgggaaagagatcttttcgcc

SEQ ID NO: 277233 - DNA, 528 bp, Homo sapiens
attattgtaactttatttatttatttatttatttacaagaggatcatccaatggaaggtctcagaggaagtttcagggcccaggattccaaaggcgggccgtggacacagtctcagggcgtctgtccccaagcgcatgccatctgcagccagcagtcttggaactttggttggtggcaccaggggacagcagtaggctgacactctcaaaggtcttctcggatggaagtctccggctccagtcgtctgtccactaagcgagaggtcctgcatgccagtaaaactactcatgtcagctgttctgcaggatcccatgagaaggtgagtcaccagaaaatgcagtttccacatcctgatgatttcatctccctaccccaactgatcaatttctccaattttccagcctctcaccctccacaatccccttaaaaactgtagcccagaactctctggaatgatgaatttgaaggtttgctcctgtctcctcactcagaagcctgtaatcattaaactctttctctgatgcaaa

SEQ ID NO: 277234 - DNA, 331 bp, Homo sapiens
tggcctcagagggtctggcggatggctgccgggatcaccgggggctggactttgagatgtccaggacgaagtgttgccctttcagtgctgccctccctgtgtctgctggaactgttggagccgcagtgcagcctaattttgacttcaggtcctgcatgccagtaaaactactcatgtcagctgttctgcaggatcccatgagaagcctctcaccctccacaatccccttaaaaactgtagcccagaactctctggaatgatgaatttgaaggtttgctcctgtctcctcactcagaagcctgtaatcattaaactctttctctgatgcaaa

SEQ ID NO: 277235 - DNA, 491 bp, Homo sapiens
tttctgcctggaatgtgcttttttgtgtatgattaccatcatcttccggctgaagtcttgcccacgctctgcacacttgaatgctccccatcttgaattttctattcctttcaatactttgtctatttctgtaggattttccctctggccttgactagactctatttccactacactgttcctcctccttgagcttactgcatgtcttaggggtgggctggaaaatgccatgggcttagtgcttttttctttctcttgaccttcagctgtgtcactctggaagctttgatcagaaaattgtagttgctgttgcctctgatgtgcaagtccaagattcttgggccgcaggacatgttctgcatatattcctggagaatagaccaacaatgagactgaatcagtaacgaaaagtcttctatgaaagaaaaacccagaaccatattgctttactgcttaattctaataaactcataaagaacaaaaaaaaccaa

SEQ ID NO: 277236 - DNA, 433 bp, Homo sapiens
caacatgctttactcctgccaggcaggttctctgtagccctctggattctgtctgcctctgttatatcttcacgaacaagttatgcagcctcaactaaagcttgtaacaaagcaaagttactctcctgagtgtgtcctctgatggatggtgagatataacttcaagatgaagcctcacccacactccctgtacaaaaacgcttctcacctgtgtcactctggaagctttgatcagaaaattgtagttgctgttgcctctgatgtgcaagtccaagattcttgggccgcaggacatgttctgcatatattcctggagaatagaccaacaatgagactgaatcagtaacgaaaagtcttctatgaaagaaaaacccagaaccatattgctttactgcttaattctaataaactcataaagaacaaaaaaaaccaa

SEQ ID NO: 277237 - DNA, 1131 bp, Homo sapiens
atccacccaccttggccttccaaagtgcagggattactggtgtgagccactgtgcctggccctaagtgtttcttatattagactttcatacttatagagttgtagaatattagaactattaatagatgagaattcaagaagattgagtctaacccctcattttatagataactgagccccagagagattatggaatactagaagtcatatattaaggtgttacttttacagtaaataaaggagatggtagtctactgtattggtgtagacccatagtaaatcatgcctatgggtattcatgctattgtatagtcatctctctttgtatctcgcctagccctgtgactcactttaaccagtagaacatagcaaaaatgacactttgctatttttgggtacaagccttgagcatgtcaggcagcttctacttttgtactcttgggagctctgagttgctgccgtgcaagaagctgtcataccttgctggagagatgatgtggagaggaagagattccaggactatatggaaagagggaggcttaactatctcagtgtcctagctgccttcagcccttagttgacttgcctgttgaatacagacacaaaagtgattagtaagattagcgaaggggccggcgtgggggcttatgactgtgcagtcccagcactctgggaggccaaggcatgtggaacacttgagcccaggagttcaagaccagcccgggcaatatagcaagacactgtctctacaaaaaaatacagaaattagctgagtgtggtggcatgtctctgtagtcctagctacttaggaggctgaggtgggaggattggtcaagcccaggagggtgaggctgcagtgaaccattatcttgccattgcactcaagcctgggcgacagagtgaaaccttgtttctctctctcacacacaaaaaaaagattaacagaggaaccacctagctaagctcagtccaggttacgaaatcataaataagtaaaatgctggttgttttaatctgttttgctggaagcagatagttttctgaattaagggacgctaagaacaaagagtatttggagctgggtgtggtagtacatgcctttagtcccagctacttaggaggttgaggtgg

SEQ ID NO: 277238 - DNA, 493 bp, Homo sapiens
ggggcatttgaactgagcccggaagtttgaataaaatttctatcactagaagctgggcacaggctcaggaggaagacattgcaggaagagggaactgtgtgagggagacatggaggccagagtactgctgacttagagggggaagaaactgatagcattaagcaggatactgagcaagcttcacccaccttctttgtcccttcttacagatattacattgtggggcatggagctgggccttctgagcatgcagagaggagagctggccaggtttctgttcaaaccgaactacgcctatggaacgctgggctcccctcccttgatccccccaaacaccactgtcctgttcaagattgagctgcttgacttcctagactgtgctgagtcagacaagttttgtgctctctcagctgtacgttgcagagcacaaatgtcagcactttatagagagacaaatgggttggtgtttttggtaattcttctagatggcctg

SEQ ID NO: 277239 - DNA, 460 bp, Homo sapiens
ggggcatttgaactgagcccggaagtttgaataaaatttctatcactagaagctgggcacaggctcaggaggaagacattgcaggaagagggaactgtgtgagggagacatggaggccagagtactgctgacttagagggggaagaaactgatagcattaagcaggatactgagcaagcttcacccaccttctttgtcccttcttacagatattacattgtggggcatggagctgggccttctgagcatgcagagaggagagctggccaggtttctgttcaaaccgaactacgcctatggaacgctgggctccatctccaaaagaaaaagaaactataaacatcattgaaagaaactaaagaagacctaaataaatggaaggaaatcatgttcatggattaaaagacttaatattattaaaatttcactacttcagaagtgatctacagattcaacacaa

SEQ ID NO: 277240 - DNA, 413 bp, Homo sapiens
gttttgggtccattttccttacattctttcctctattctagtgaaatactatggatacctggaacacttggacagacccttcgattctaattactttaggaaaactcctcggctaatgaaacttggagagggtaaattcagagtaggagctggagaagaagggattgtttaggagcgagatgaggcaccatgcctcaggctgggaagactgctcagagcgcaggttctttgaattgactttgctgaggctgggttttggtaaaacagccatgttctctccccttgagacctaggcatttgggagatggcttaatgggcaaggtataatctttgcactctgacttaactcaccactgggaatgtttctttgttcatttattaagtaaaaatcgacgaatgcttacttcccacaa

SEQ ID NO: 277241 - DNA, 619 bp, Homo sapiens
aacgatgagtgcctcctcgtggccccagaatgtaatgccgccgtcggtaggggtctgccgggcataaaggggccttcggaaccccaccagagtcacagccaggaagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagatattacattgtggggcatggagctgggccttctgagcatgcagagaggagagctggccaggtttctgttcaaaccgaactacgcctatggaacgctgggctcccctcccttgatccccccaaacaccactgtcctgttcaagattgagctgcttgacttcctagactgtgctgagtcagacaagttttgtgctctctcagctgtacgttgcagagcacaaatgtcagcactttatagagagacaaatgggttggtgtttttggtaattcttctagatggcctg

SEQ ID NO: 277242 - DNA, 1698 bp, Homo sapiens
aacgatgagtgcctcctcgtggccccagaatgtaatgccgccgtcggtaggggtctgccgggcataaaggggccttcggaaccccaccagagtcacagccaggaagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagtgaaatactatggatacctggaacacttggacagacccttcgattctaattactttaggaaaactcctcggctaatgaaacttggagaggatattacattgtggggcatggagctgggccttctgagcatgcagagaggagagctggccagatgcttcgtcttgggtaaactcctcgactcccaaggccccagcctccatctttacctcagagcctcctgaacctcctcctccagcctcaccttcctccagcctcaccactcctccctggacctgcagctccgcacccccgggggcctcagaactaccccttccagggcctcagaactacccctacagtttctcctgcgtaaccttctgcctaccttcctgagagtggttggtgacagcagccggggctagaaacctcgaggcgactgtgcttgagtcctctcttgctctttacatcccaaatcccatcaattgtcacgccttgtgccttccgcctctcaaatattcagaaagcagatgtatgctgggcacggtggtgactcaagcctataatcccagcacttcggaaggcggaggcaggaggatcgcttgaggccaggaattttagaccagccggggcaacatagtgaaaccctgttctcctaaaaaacacaaaaattagtcgggtgtggtggcgggcacctatgatcacagctactcaggagggtgaggcaggagaatcgcttgaacctaggaggcggaggctgcagtgggctgagatcgcaccactgcactccagcctgggggacagagcgagaccccgtctcaaacaaacaaaacaaaacaaaatgaggacaatggggcttccaatggcaactcgagacgttagtttactccagagtcatggagacagtgaatggagtgtgtgtgtgtgtgtgtgtgtgtgtgtgtgcgtgtgcgtgagtgagagagagagagaggaagaagggagggagggacggttacaggagtgtgggaaagtcaacaggaaaaggagggaaggttcgctgtgaactgacagtaactgtgacatcacaggcatgtgcggagtccccgcccccccaggcactgtgccaaggccagtaccttcatgtcatgagaccctctcagcaactctgtaaccttgtccccaccagaatattcctttcacagctgagaaaacaacagcacagagaggatgaattaaaaattgtctaacatgctgggcgcagtggctcacgcctgtaatcccagcactttgggatgatgaggcaggtggatcacaaggtcaagagatcaagaccatcctggctaacacggtgaaaacccgtctctactaaaaatacaaaaaagttagccaggcgtggtggcgggcg

SEQ ID NO: 277243 - DNA, 1682 bp, Homo sapiens
aacgatgagtgcctcctcgtggccccagaatgtaatgccgccgtcggtaggggtctgccgggcataaaggggccttcggaaccccaccagagtcacagccaggaagggcagcggggcgcaccaggccgaaggctcacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagtgaaatactatggatacctggaacacttggacagacccttcgattctaattactttaggaaaactcctcggctaatgaaacttggagaggatattacattgtggggcatggagctgggccttctgagcatgcagagaggagagctggccagatgcttcgtcttgggtaaactcctcgactcccaaggccccagcctccatctttacctcagagcctcctgaacctcctcctccagcctcaccttcctccagcctcaccactcctccctggacctgcagctccgcacccccgggggcctcagaactaccccttccagggcctcagaactacccctacagtttctcctgcgtaaccttctgcctaccttcctgagagtggttggtgacagcagccggggctagaaacctcgaggcgactgtgcttgagtcctctcttgctctttacatcccaaatcccatcaattgtcacgccttgtgccttccgcctctcaaatattcagaaagcagatgtatgctgggcacggtggtgactcaagcctataatcccagcacttcggaaggcggaggcaggaggatcgcttgaggccaggaattttagaccagccggggcaacatagtgaaaccctgttctcctaaaaaacacaaaaattagtcgggtgtggtggcgggcacctatgatcacagctactcaggagggtgaggcaggagaatcgcttgaacctaggaggcggaggctgcagtgggctgagatcgcaccactgcactccagcctgggggacagagcgagaccccgtctcaaacaaacaaaacaaaacaaaatgaggacaatggggcttccaatggcaactcgagacgttagtttactccagagtcatggagacagtgaatggagtgtgtgtgtgtgtgtgtgtgtgtgagtgagagagagagagaggaagaagggagggagggacggttacaggagtgtgggaaagtcaacaggaaaaggagggaaggttcgctgtgaactgacagtaactgtgacatcacaggcatgtgcggagtccccgcccccccaggcactgtgccaaggccagtaccttcatgtcatgagaccctctcagcaactctgtaaccttgtccccaccagaatattcctttcacagctgagaaaacaacagcacagagaggatgaattaaaaattgtctaacatgctgggcgcagtggctcacgcctgtaatcccagcactttgggatgatgaggcaggtggatcacaaggtcaagagatcaagaccatcctggctaacacggtgaaaacccgtctctactaaaaatacaaaaaagttagccaggcgtggtggcgggcg

SEQ ID NO: 277244 - DNA, 1482 bp, Homo sapiens
ggggcatttgaactgagcccggaagtttgaataaaatttctatcactagaagctgggcacaggctcaggaggaagacattgcaggaagagggaactgtgtgagggagacatggaggccagagtactgctgacttagagggggaagaaactgatagcattaagcaggatactgagcaagcttcacccaccttctttgtcccttcttacagatattacattgtggggcatggagctgggccttctgagcatgcagagaggagagctggccagatgcttcgtcttgggtaaactcctcgactcccaaggccccagcctccatctttacctcagagcctcctgaacctcctcctccagcctcaccttcctccagcctcaccactcctccctggacctgcagctccgcacccccgggggcctcagaactaccccttccagggcctcagaactacccctacagtttctcctgcgtaaccttctgcctaccttcctgagagtggttggtgacagcagccggggctagaaacctcgaggcgactgtgcttgagtcctctcttgctctttacatcccaaatcccatcaattgtcacgccttgtgccttccgcctctcaaatattcagaaagcagatgtatgctgggcacggtggtgactcaagcctataatcccagcacttcggaaggcggaggcaggaggatcgcttgaggccaggaattttagaccagccggggcaacatagtgaaaccctgttctcctaaaaaacacaaaaattagtcgggtgtggtggcgggcacctatgatcacagctactcaggagggtgaggcaggagaatcgcttgaacctaggaggcggaggctgcagtgggctgagatcgcaccactgcactccagcctgggggacagagcgagaccccgtctcaaacaaacaaaacaaaacaaaatgaggacaatggggcttccaatggcaactcgagacgttagtttactccagagtcatggagacagtgaatggagtgtgtgtgtgtgtgtgtgtgtgtgtgtgtgcgtgtgcgtgagtgagagagagagagaggaagaagggagggagggacggttacaggagtgtgggaaagtcaacaggaaaaggagggaaggttcgctgtgaactgacagtaactgtgacatcacaggcatgtgcggagtccccgcccccccaggcactgtgccaaggccagtaccttcatgtcatgagaccctctcagcaactctgtaaccttgtccccaccagaatattcctttcacagctgagaaaacaacagcacagagaggatgaattaaaaattgtctaacatgctgggcgcagtggctcacgcctgtaatcccagcactttgggatgatgaggcaggtggatcacaaggtcaagagatcaagaccatcctggctaacacggtgaaaacccgtctctactaaaaatacaaaaaagttagccaggcgtggtggcgggcg

SEQ ID NO: 277245 - DNA, 260 bp, Homo sapiens
ggaagtcaaaagtgcctataacccatgaaagtctaaatgaggacaacggaggctgggcatggtggctcactcctgtaatcccagcactttgggaggccaaggtgggcggatcacctgaggtcaggagtttgagaccagcctggccaacataggtgaaaccctgttctcctaaaaaacacaaaaattagtcgggtgtggtggcgggcacctatgatcacagctactcaggagggtgaggcaggagaatcgcttgaacctag

SEQ ID NO: 277246 - DNA, 456 bp, Homo sapiens
agcttaactgatgagatccattttctcttccatcaagcatcttcttgtgtattgtcttaatccaaatccttgacagaaatgctgaagaggacctctgtaggctaggttgatcctgaattctcaaatagcactgactggtacgcagtttaaccaagtcagtttcacctaaaagtgtgattatccaacccacatgttgccattctgttaaaaaggatggtacaaaagacagtcacagtcacctggcttactgacataaatattaatattaatccaataagtaaaaagcacatgagaattggctgccacagaaagaaaaatttcgacctgtatctaccaagaaactatcttaccaactaaagaagccaaatctgtctctctttcaaaaccctcatggggccatgttttattataatggtttgtcacaggtcctaacccatactgtatttgattatatac

SEQ ID NO: 277247 - DNA, 843 bp, Homo sapiens
acttcgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccagggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaa

SEQ ID NO: 277248 - DNA, 645 bp, Homo sapiens
acttcgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcggttgaaatttataagagtttccgcccagggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaa

SEQ ID NO: 277249 - DNA, 768 bp, Homo sapiens
acttcgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccagggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaa

SEQ ID NO: 277250 - DNA, 688 bp, Homo sapiens
taagagacaaggtcttactctctcacccaggctagaatgtagtggcacaatcatacctcactataacctcaaactgctgggctcaagcgatctcccgcctcagcctcctgagtagctgggactacagatgagcatcaccacatcaagctaatttttcatttttcttttgtacagacaaggtcttgctttgttgctcaggctggttttgaactcctggcctcccaaggtgctgatagtacaggcatgaaccactgtgcttggccttttaaaattttgtagagatgcagtcttactatgttgcccaggctgtctcaaactcctggcctcaagtggtcctcctgccttggcctcccaaaatgttgcaattacaggcatgagccactgtgcttggcaagctaaggaggattttcactagcagtttcatttgacaataccaatctagaggtgagcttctcaatctttaatgtgtatcaaatcacctggggaatagatgccgattctgaaacaggtctggagtgagactgaggttctgcatgtataacaagctccagggggccagctgtcacattcgcaatcacatttgagaaacaggttgaggtgttttttcacagaggcatcagaccaccaaagcggtacaggtcagccttcctagatcttttaccagtccggattgggcaatcgcttatct

SEQ ID NO: 277251 - DNA, 756 bp, Homo sapiens
  misc_feature (756)..(756): n is a, c, g, or t
acttcgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccggtaagaagtatccttttcacatataccttagcaactggaataagattaggatagactaggacaccagaattttgagcaacagttacaattcctatttttcttttgcccgtttttctttcttctttgtgctttgattctcccctagtagtatccaaaaaatacatggatgatctaggacaaaaggaaaatattaacgagagggtttaaaagtaaagcaaaggctgggcgcggtggctcacgcctgttatcctagcactttgagaagctgaggcgggtggatctcttgagatcaggagtttgagaccagcctagccaacatggtgaaaccccatctctgtaaaattcattgtctggcacagggctacccctggatcccaatactttggaggtgggggtggtcctccgccn

SEQ ID NO: 277252 - DNA, 992 bp, Homo sapiens
caagaaggctaaacggcctacagcttctgggggcccgtgaccgatgcagcattttttctgcaggcgaacgtctgtgtaacttggaggagggcagcccgggcagcggcacctacacccgccacggctacatcttttcgtcgcttgccggctgtctgatgaagagcagcgagaatggcgcgtttcttctagccgtatcgccgctgtggtgcacttagccaccacacactagttgtgttgatctcgcttggttgtgctgctgaccctcggggagggaagttgggacaaaagcagatgcgaactcagtatcccatcccagcccagctcagcccagcacttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccagggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaa

SEQ ID NO: 277253 - DNA, 1020 bp, Homo sapiens
acttcgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccagggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaaaaaaaaaaattttgtggggggtgggccgaaaaaagttttaaaacacctgtggggggggggcaagagggtaggaaagggatagggtggccagagaactgggagaaatgggggggttccacaataaaacgggggacgggggttggaaaccagggttgggagggttaaggggcggggaaa

SEQ ID NO: 277254 - DNA, 471 bp, Homo sapiens
ctccggcgctctgaggatcccctataggcgctaggtgacatttcttggcaaagtgtgactagatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaa

SEQ ID NO: 277255 - DNA, 627 bp, Homo sapiens
acacacgtccccttcatttaggtacattgtgatttaatgaaaatttgaggacacgtggtgatacagatagcatgtgaggcaggcatggtggctcatgtttgcaaagcccagcctgattctccttatataaatccaaggaaacgggactcacttcataagtcagtagaatgaacaaagttttttctttatgagttgaggttcagtaggaagcttggtggcacttcagcttcatacccagcataaaagaggagtcgcaggcaaatctttggggtctgggctccaccaccagcttttcccttccaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaa

SEQ ID NO: 277256 - DNA, 1504 bp, Homo sapiens
  misc_feature (1422)..(1422): n is a, c, g, or t
  misc_feature (1479)..(1479): n is a, c, g, or t
  misc_feature (1502)..(1503): n is a, c, g, or t
aaggatccccacaccacctgagttctttcagtgtcggtaatgcgccaagctttctcctgctacagagcctttgtaacatgccatctatctggaacgcttctatcttcctaggcctatttaattcctacctcctttagatagcttctctactatcacctcagagaagtccttctggacccactaattgaggaaaggagttttgtggggtgttttgtttttgtttgttttgttaaagactcacaaaaaactctgttccttttcttccaagcactatgtcagcatatgatgagacactcaggtatatgtttcctactagacttctcccctgcttaaatctaagtccgtgaaagcaggccctaccaccataccatccgtatatagcacaaggcagctcctcaataaatgttgaatgtgtgagtaatacctacctttctagtttcagagatagatccaggattagctcaggatcatataagcaatatttgaaggagcacaatagaaagaggattcagaattagaacagttacgttctggctaacttgactttgattctgctttgagtaagtaacttaagctgtctgattcaaggggctttctattcagtcattgttgggaatgttcttaacagtcctgagtttgttcatttcatagatatcacttgagtattttcatgtgtcaggcacagcgctgacttggtttctgctatcaaaggacacagacacaaattgtaaacaaataaatgctcaaatgagcatatggttacatatgtggtggtgctttgaaagaatattacagggcaccttgagaacatgtaacaggcaaacccatcctagtcagcagaagtgacatttaagctgaatcatctaaagagtaggtaagagtcaggtgggtggagagagtgcagctctggcagaaagaataggttgaagagagatctgaaagtgggaagaatttagtaagttggggaaactgaaagaaggccaggagagctgaagcattgtgagcaacggagagattgataaaagatgaggctcaaaatatctgtcttataccaacagccaataccatgctcaaagagaaaactctgcaagtattcacttaaaatagaagaaaacaagcatagccgctattatgtaacatttttgtggaaatttcagcctgtgcaataaaataagaaacagaaggaagcagtataactttggaggaaagagtaaattgtcggcagggcgcagtggctcacacctgtaatcccagcactttgggaagccaaggcaggtggatcacctgaggtcaggagttcgagaccagcctggccaacatggtgaaaccccatctctactaaaaatacaaaaaattacccgagcatggtgacaggcttctgtaatcccagctactcgggaggctgaggcaggagaatcactngaacccaggaggtggaggttgcagtgaaccaagatggcacccttgcactccatcctnggcaacaagagtgaaactccatnnc

SEQ ID NO: 277257 - DNA, 754 bp, Homo sapiens
  misc_feature (672)..(672): n is a, c, g, or t
  misc_feature (729)..(729): n is a, c, g, or t
  misc_feature (752)..(753): n is a, c, g, or t
acttcgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgtttcagagatagatccaggattagctcaggatcatataagcaatatttgaaggagcacaatagaaagaggattcagaattagaacagttacgttctggctaacttgactttgattctgctttgaccaataccatgctcaaagagaaaactctgcaagtattcacttaaaatagaagaaaacaagcatagccgctattatgtaacatttttgtggaaatttcagcctgtgcaataaaataagaaacagaaggaagcagtataactttggaggaaagagtaaattgtcggcagggcgcagtggctcacacctgtaatcccagcactttgggaagccaaggcaggtggatcacctgaggtcaggagttcgagaccagcctggccaacatggtgaaaccccatctctactaaaaatacaaaaaattacccgagcatggtgacaggcttctgtaatcccagctactcgggaggctgaggcaggagaatcactngaacccaggaggtggaggttgcagtgaaccaagatggcacccttgcactccatcctnggcaacaagagtgaaactccatnnc

SEQ ID NO: 277258 - DNA, 1659 bp, Homo sapiens
acttcgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccagggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaactgtgatattggaaatagcctatccctcctgacagtccttataaatacatattttttgctatgataaaacttttttactaaaaggatgttatagagtctgttgtcttaagcagagaaagacatctaaatggtgtcaggacatttcagtacttctgcttattgagtacttactgtgctaggcactgagtcaggtgctttacatacgtccccttcatttaggtacattgtgatttaatgaaaatttgaggacacgtggtgatacagatagcatgtgaggcaggcatggtggctcatgtttgtaaatcccagcactttgggaaggccgagctggttttgaactcctggcctcccaaggtgctgatagtacaggcatgaaccactgtgcttggccttttaaaattttgtagagatgcagtcttactatgttgcccaggctgtctcaaactcctggcctcaagtggtcctcctgccttggcctcccaaaatgttgcaattacaggcatgagccactgtgcttggcaagctaaggaggattttcactagcagtttcatttgacaataccaatctagaggtgagcttctcaatctttaatgtgtatcaaatcacctggggaatagatgccgattctgaaacaggtctggagtgagactgaggttctgcatgtataacaagctccagggggccagctgtcacattcgcaatcacatttgagaaacaggttgaggtgttttttcacagaggcatcagaccaccaaagcggtacaggtcagccttcctagatcttttaccagtccggattgggcaatcgcttatct

SEQ ID NO: 277259 - DNA, 2106 bp, Homo sapiens
  misc_feature (2024)..(2024): n is a, c, g, or t
  misc_feature (2081)..(2081): n is a, c, g, or t
  misc_feature (2104)..(2105): n is a, c, g, or t
acttcgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcggtaaaggaagcggcatgccatctcccctctgtttttcccttaggctgcccttgagttccagtccttaggcatgggcactgcggacgcgtctttagtgcctcagtggtacaatgttggtctcttagtttcttctagccgtatcgccgctgtggtgcacttagccaccacacactagttgtgttgatctcgcttggttgtgctgctgaccctcggggagggaagttgggacaaaagcagatgcgaactcagtatcccatcccagcccagctcagcccagcagtgagttgcatactgtatgaatgttgcttacctttccgactttatctagcgccactatctccacctcactgacgcaatctagtcatactgtcttttctgtgtttaaaagttataatcacagtctctgcttgccctttaaaaattttttataacatactagcttctttcagtgtcggtaatgcgccaagctttctcctgctacagagcctttgtaacatgccatctatctggaacgcttctatcttcctaggcctatttaattcctacctcctttagatagcttctctactatcacctcagagaagtccttctggacccactaattgaggaaaggagttttgtggggtgttttgtttttgtttgttttgttaaagactcacaaaaaactctgttccttttcttccaagcactatgtcagcatatgatgagacactcaggtatatgtttcctactagacttctcccctgcttaaatctaagtccgtgaaagcaggccctaccaccataccatccgtatatagcacaaggcagctcctcaataaatgttgaatgtgtgagtaatacctacctttctagtttcagagatagatccaggattagctcaggatcatataagcaatatttgaaggagcacaatagaaagaggattcagaattagaacagttacgttctggctaacttgactttgattctgctttgagtaagtaacttaagctgtctgattcaaggggctttctattcagtcattgttgggaatgttcttaacagtcctgagtttgttcatttcatagatatcacttgagtattttcatgtgtcaggcacagcgctgacttggtttctgctatcaaaggacacagacacaaattgtaaacaaataaatgctcaaatgagcatatggttacatatgtggtggtgctttgaaagaatattacagggcaccttgagaacatgtaacaggcaaacccatcctagtcagcagaagtgacatttaagctgaatcatctaaagagtaggtaagagtcaggtgggtggagagagtgcagctctggcagaaagaataggttgaagagagatctgaaagtgggaagaatttagtaagttggggaaactgaaagaaggccaggagagctgaagcattgtgagcaacggagagattgataaaagatgaggctcaaaatatctgtcttataccaacagccaataccatgctcaaagagaaaactctgcaagtattcacttaaaatagaagaaaacaagcatagccgctattatgtaacatttttgtggaaatttcagcctgtgcaataaaataagaaacagaaggaagcagtataactttggaggaaagagtaaattgtcggcagggcgcagtggctcacacctgtaatcccagcactttgggaagccaaggcaggtggatcacctgaggtcaggagttcgagaccagcctggccaacatggtgaaaccccatctctactaaaaatacaaaaaattacccgagcatggtgacaggcttctgtaatcccagctactcgggaggctgaggcaggagaatcactngaacccaggaggtggaggttgcagtgaaccaagatggcacccttgcactccatcctnggcaacaagagtgaaactccatnnc

SEQ ID NO: 277260 - DNA, 838 bp, Homo sapiens
caagaaggctaaacggcctacagcttctgggggcccgtgaccgatgcagcattttttctgcaggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccagggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaa

SEQ ID NO: 277261 - DNA, 1266 bp, Homo sapiens
acttcgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggttgaaatttataagagtttccgcccagggtgacattgtcttggccaaagtggtatcctttattcccagcagacttctggtcctttgtcaaaagaagagaaggaggccgggtgtggtggctcatgcctgtaatcccagcactttcggaggccagggcgggtggatcacctgaggtcaggagttcgagaccagcctggacaacatggtgaaaccctgtctctactaaaaatacaaaaattagctgggcgtggtggcacatgcctgtaatcccagctattcgggaagctgaggcaggagaaccgcttgaacctgtgaggcagaggttgtgaactgatatcacgccaccgcactccagcctggttaacggagcaagactccatctcagaaaaaaaaaaggtagaaaaacaactcaggtggctaaggtgggggaagacttctaactcctcattttccttcaccggtgttatgtgactagatctccttaggtgatgcacagtccaactacctgctaaccaccgccgagaacgagctgggagtggtggtagcccacagtgagtcaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaa

SEQ ID NO: 277262 - DNA, 706 bp, Homo sapiens
acttcgttttcatcctggttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccgcaaggaagatgtccgagcaactgaaaaagacaaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaa

SEQ ID NO: 277263 - DNA, 499 bp, Homo sapiens
  misc_feature (296)..(296): n is a, c, g, or t
  misc_feature (298)..(298): n is a, c, g, or t
  misc_feature (300)..(300): n is a, c, g, or t
  misc_feature (302)..(302): n is a, c, g, or t
  misc_feature (305)..(305): n is a, c, g, or t
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcaggtggggagaatctggagaaaaggcgcaccctgcggcctcggagaccattatgtctcagggagtctctcgcagtgggagaggtcgtcggggcaggcggagggtcctcagagtcgggggtggggggcctgtggngngncnggnccccggcccacaccggggagtgcggcgaccagacggccagctgccgaatctgaggcctcggtgggtccgtcgcccgcctctcttggacaagtccaggcgatgtgagcacgcccagcctcctacatttcactcccgtctctcccaaacagacctagcgcaaaacgagcactgacacagcgggggcccacatcccg

SEQ ID NO: 277264 - DNA, 2380 bp, Homo sapiens
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcccggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaatgtat

SEQ ID NO: 277265 - DNA, 1906 bp, Homo sapiens
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaatgtat

SEQ ID NO: 277266 - DNA, 1200 bp, Homo sapiens
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcccggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaatgtat

SEQ ID NO: 277267 - DNA, 2157 bp, Homo sapiens
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcccggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaatgtat

SEQ ID NO: 277268 - DNA, 949 bp, Homo sapiens
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaatgtat

SEQ ID NO: 277269 - DNA, 1295 bp, Homo sapiens
  misc_feature (3)..(3): n is a, c, g, or t
ccnatggctccgaagtccccgctggcatcctgaaagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcccggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaatgtat

SEQ ID NO: 277270 - DNA, 2409 bp, Homo sapiens
  misc_feature (2371)..(2371): n is a, c, g, or t
  misc_feature (2373)..(2375): n is a, c, g, or t
  misc_feature (2379)..(2379): n is a, c, g, or t
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcccggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaattctgatgcggccaaanannngtcnccccacccccccccctctctgttccgcgtc

SEQ ID NO: 277271 - DNA, 1423 bp, Homo sapiens
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcccggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaatgtat

SEQ ID NO: 277272 - DNA, 2483 bp, Homo sapiens
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcccggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactggtaggtacactttcctaccataatatttaggccttaacacacgcgcgttttaagcattttgatttcttgacctggagatttagatatttaaaaacaatttgagataataagttggggtatactctaacttcctggggttactgtctccaacttcctaaacaccagttactaataaatgcacagcaggtgcactgtacca

SEQ ID NO: 277273 - DNA, 1805 bp, Homo sapiens
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgctccagaaggccttactgcaccagaaattgaaccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaatgtat

SEQ ID NO: 277274 - DNA, 2474 bp, Homo sapiens
tggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagacggactctagctgtgtcacccaggctggagtgcagtggcgcgatctcggctgtcagctccgcctcccggattcacgccattctcctgcctcagcctcccgagtagctgggactacaggcacccgccaccacgcccggctgattttttgttttagtagagacggggtttcaccgtgttagccaggatggtctccatctcctgacctcgcctcgtgatccgcccgactcggcctcccaaagtgctgggattacaggcgtgagccaccgcgcccggcctctgggagccactttcaaaacggtctatctactcactttggtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcccggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcataaaaaaatgtat

SEQ ID NO: 277275 - DNA, 506 bp, Homo sapiens
atttggaagaaaaaaagcactcaaaaaataccaatgtttattttttaataaagcaataattcaaaacaatttttttttctactcattcaaaaggtcataactcaggagtgctgtttataccagatgaatctacaaagccaagaacaggaatcaccgtatctccttcagtagacctgatactgtgagtcttctcttttctgttgacatatttgtgcaacatgctgtagtactggcccttcggattgaaagtatacagtgatgaaatttgctgccactctttcatgcttggagtgttatattcttttggatgcgagccctcaaagaaacatttaatattctcttttgccaattcagttgcatgctctgtggctttacttttaaggatctgctgctcctgttccaaatagattttccagaatttcagctgcagaaaactaactggagataggcatcgggtgacagatgtaaaaatcagaagaatgatgataacaactgctatcaagatc

SEQ ID NO: 277276 - DNA, 898 bp, Homo sapiens
atttggaagaaaaaaagcactcaaaaaataccaatgtttattttttaataaagcaataattcaaaacaatttttttttctactcattcaaaaggtcataactcaggagtgctgtttataccagatgaatctacaaagccaagaacaggaatcaccgtatctccttcagtagacctgatactatatgtcataacactgtcaatgcctggaggagagtaaaattctgactctgaccaccaagctgatctgcacagaaggggatacatgattattcaaagaatgctagttgaacccaaaatttcaaactgcagctacatctatctaatgttgtttcctccaccttcagttttctcaagcagcgttgttctgacacaaacactgtaaccacttttgtgatattgagccttactctgtgtgactccagactgagctgaggtgtgcttgaaagaacatgggctttgaagtcaagtgcatcttgtctgtggtgtgtttaacaagtatgcccctctgagacacagcatccttatttgtaaaagaaggataataatgcccacttttcaagattactgacatgagtagattgagtagcatatgtaaagtgcctttacatataggatatgtctgttaaatgaatgatcagtgtgagagttttccccttaaaatgcaatttggggaatagacaacaaataattacattgtacataacctaagaatcttgatgaatactgaattttgaattttaaacgaggatcaattcaggggatagtattaagtgactcaatgactctgctaccttaagagaattggtgtacaccttagctgtctgcttcaccacaaggagagtatctggatatggagcttgggtgggcagttcacaatgaaatggttcttattggtgc

SEQ ID NO: 277277 - DNA, 845 bp, Homo sapiens
gcccgccgcggttgatcccgcggaacctttgggcgggcgcccgagggtttttggtttaccgctataccagatgaatctacaaagccaagaacaggaatcaccgtatctccttcagtagacctgatactatatgtcataacactgtcaatgcctggaggagagtaaaattctgactctgaccaccaagctgatctgcacagaaggggatacatgattattcaaagaatgctagttgaacccaaaatttcaaactgcagctacatctatctaatgttgtttcctccaccttcagttttctcaagcagcgttgttctgacacaaacactgtaaccacttttgtgatattgagccttactctgtgtgactccagactgagctgaggtgtgcttgaaagaacatgggctttgaagtcaagtgcatcttgtctgtggtgtgtttaacaagtatgcccctctgagacacagcatccttatttgtaaaagaaggataataatgcccacttttcaagattactgacatgagtagattgagtagcatatgtaaagtgcctttacatataggatatgtctgttaaatgaatgatcagtgtgagagttttccccttaaaatgcaatttggggaatagacaacaaataattacattgtacataacctaagaatcttgatgaatactgaattttgaattttaaacgaggatcaattcaggggatagtattaagtgactcaatgactctgctaccttaagagaattggtgtacaccttagctgtctgcttcaccacaaggagagtatctggatatggagcttgggtgggcagttcacaatgaaatggttcttattggtgc

SEQ ID NO: 277278 - DNA, 846 bp, Homo sapiens
ccacgcacgtcgcgaatttagtctgatagcctccaacgcccccgcccaggccatactcgagcgtataccagatgaatctacaaagccaagaacaggaatcaccgtatctccttcagtagacctgatactatatgtcataacactgtcaatgcctggaggagagtaaaattctgactctgaccaccaagctgatctgcacagaaggggatacatgattattcaaagaatgctagttgaacccaaaatttcaaactgcagctacatctatctaatgttgtttcctccaccttcagttttctcaagcagcgttgttctgacacaaacactgtaaccacttttgtgatattgagccttactctgtgtgactccagactgagctgaggtgtgcttgaaagaacatgggctttgaagtcaagtgcatcttgtctgtggtgtgtttaacaagtatgcccctctgagacacagcatccttatttgtaaaagaaggataataatgcccacttttcaagattactgacatgagtagattgagtagcatatgtaaagtgcctttacatataggatatgtctgttaaatgaatgatcagtgtgagagttttccccttaaaatgcaatttggggaatagacaacaaataattacattgtacataacctaagaatcttgatgaatactgaattttgaattttaaacgaggatcaattcaggggatagtattaagtgactcaatgactctgctaccttaagagaattggtgtacaccttagctgtctgcttcaccacaaggagagtatctggatatggagcttgggtgggcagttcacaatgaaatggttcttattggtgc

SEQ ID NO: 277279 - DNA, 467 bp, Homo sapiens
cacagaatgatgacacagcgaggctggggagggaacaggggttgtgcaggatgtgagtcagagaccaggctgttttgcggcctcaaaatcttggacttgaacctggaggcagcagggagccacttcagggtccgtttctttaattaaaatatttgaatcaacaatagagtcgcatggctcacaaaccaacaaatatacaagggaaatggaaaagtttccttttgacgtccccactcccattttcattagtctcccaggttagttttctgtgtcgcctttcagagtttaagtgaaacaatggtcagtgaagatttttatttttcctgttaacacaaaatattatggtgtcattctgcacctggctttttttgcttagtgatgaaaaatttaccctttaaagtgtatataattcagtggtttttcagtatgtttacagagttgtgtaactgtgaccactatctcatttt

SEQ ID NO: 277280 - DNA, 437 bp, Homo sapiens
acagagggcgtccaagatgcagacatggtactcgttcagagccgcctctcctgtaagacaccacaaaggtcacagcagctcccaccacaggcagggcactgctcggggctgcaagtgtcttattcctcagcaaccacgtgggggcagctctggctcaccccacttccaggaaggtggcctgggagaaggcaggaagaggaggccgacagggacagaggaagcaggagtgtccagcctacacatgcgtgcatagacagagccctaagacctgctgcactgaggtcaatcctgcctgacctcactgagattcaatcctgcctaacttaggaataatcaagagactgggaattttctcactctagtttttagagaaatagaaaatttcaaaccatgttaaaaagttatttaataaaatgttcaatatttttcatacatac

SEQ ID NO: 277281 - DNA, 435 bp, Homo sapiens
gctcaagagggaggggccccagccacgagggaggggcagggactttcttctcacaaagacctttcttcagtattcgaaggtcactgtcttgacccgcaggtactcgttcagagccgcctctcctgtaagacaccacaaaggtcacagcagctcccaccacaggcagggcactgctcggggctgcaagtgtcttattcctcagcaaccacgtgggggcagctctggctcaccccacttccaggtgagaagtcgaggcccagcgaggtcatgaatcttacccaggttatccctggcagtggatagtgggccaggactccccagaatacaaagccaatctgaggcagccatttaagaatcttccccagctcccaccgccttgtctggacagtgggaagccccttcaggtggaagggggtggagagacttggcgttact

SEQ ID NO: 277282 - DNA, 900 bp, Homo sapiens
aaagtcgtgcttcaactcattaggaaaaaaaaagagggcctgctggtaacacctcttaacctccaccgctacacggtcttcctcagatggctgtttgagaaggctgttcttcaacatgtgaaacatttcctcctttgaaatgaatccgtcaccattcaaatcaaacacttcaaagcaatctttttaagaaaataacaaatcatgaatttgatgctatcagtaagatcctcgaagaaacagtgataatccatgaatccactccaatacatttacacagccatcattatctttatcaaaacctcggaatactaaagggagagaggttaaatggaacacctgtcctgcatgataactctcagtaaagtatctacattggcatcactcacttttaaaattaagagaacacttcagcttgtgaagtccaatattctcatttgacgaaagaggaaactaagacatcataatatcatgaaactcttttattaaacattcaatttttaaaatgtttttgtgggaacaaatacaattctcaatgtctaagtatattaatcattatttaataataaatatgttgctataaaatatgttggtcatattagataaatatatgaatataaataaaatacttaatagttttgttactcaagtcattacttgatgcatagaattatatcttgtcactgaaatatcttctatgatgtaaagaatgtaaatgtccttttaaaactattctatttattatgtttattaagtggaaatcgaaatgttttaggttttctgatataaggtaagagaaagatgtcaacatgactttgtcttcttcttaaatacacaaaataaagccgatgcggtccgccttattacgtaactatctcatcctcccgtcgtccgccgccattt

SEQ ID NO: 277283 - DNA, 891 bp, Homo sapiens
aaagtcgtgcttcaactcattaggaaaaaaaaagagggcctgctggtaacacctcttaacctccaccgctacacggtcttcctcagatggctgtttgagaaggctgttcttcaacatgtgaaacatttcctcctttgaaatgaatccgtcaccattcaaatcaaacacttcaaagcaatctttttaagaaaataacaaatcatgaatttgatgctatcagtaagatcctcgaagaaacagtgataatccatgaatccactccaatacatttacacagccatcattatctttatcaaaacctcggaatactaaagggagagaggttaaatggaacacctgtcctgcatgataactctcagtaaagtatctacattggcatcactcacttttaaaattaagagaacacttcagcttgtgaagtccaatattctcatttgacgaaagaggaaactaagacatcataatatcatgaaactcttttattaaacattcaatttttaaaatgtttttgtgggaacaaatacaattctcaatgtctaagtatattaatcattatttaataataaatatgttgctataaaatatgttggtcatattagataaatatatgaatataaataaaatacttaatagttttgttactcaagtcattacttgatgcatagaattatatcttgtcactgaaatatcttctatgatgtaaagaatgtaaatgtccttttaaaactattctatttattatgtttattaagtggaaatcgaaatgttttaggttttctgatataaggtaagagaaagatgtcaacatgactttgtcttcttcttaaatacacaaaataaagcccgatacgaacacgtcccctcttccataacccacacaacccaaacccc

SEQ ID NO: 277284 - DNA, 824 bp, Homo sapiens
tgaaactgagtctcgctctgtcgcctaggctggagtgcagtggtgcaatctcagctcactgcaacctccgtctcccgggttcaagtgattctcctgcctcagcctgttgagtagctgggactacaggtgcgtaccaccaagcccagctaatttttttatatttttagtagagacggggtttcactgtgttagccaggatggtctcaatctcctgacctcatgatccgcccaccttggcctcccaaagtgttgggattacaggcatgagccactgcccctggacagatctaattttttaatagtgtaagagagatacactgtgcattccatctatgtcctgagttagtaattcaagtaccaaaaagtaatttaatatgaaactccttgaaaattcagagcttacacttggaattcaaaatgcctatttttgattgtttaaaagttacttaaacctgagctttaggacctttaaaatctcagcatgccttttaagctagtacttttcctgttttgagctctagcaaaccttcagcaagccaaggtggtagccctttttcaacacaatcaaaatagagaggtcaccagttgtttactaccttatggtaaaatgcccggatcaagatccatgtatcccccccatattgtgatgatgcaatcaaagcatagtttttttctactttctgaaatattactgatgaaatcactttacatttaagaggagaaaacagactgccttggattttttttttgtcttgagagaaaaaacaaaatatttagtattgcaagcataaacatttggactcaataaatgacaaattatgaaa

SEQ ID NO: 277285 - DNA, 277 bp, Homo sapiens
accaggggagtcagtggcacaagtcccaatccaggtccaatggtccaagaaccaggggcaccagaagacggacatcccaggttaagcggagagagaaagttcacccttcctccacttttgtgttctattctggccttcaacaaattggatgattgcccacccacactggtgaaggccatctttttactcagtctaccaattcaatgctaatctcttttggaaacaccttcacagacataccaagaaataatgttttaccatctatctagccattcct

SEQ ID NO: 277286 - DNA, 411 bp, Homo sapiens
ttagctaacttgccccaggtcacacagctactatctgacatagctgggatttgaatccagaccatcaagctctagaatctactctccaattgagcacacaatatggcctttcagtaattcaggaagatcagtaagcaaatggataggtggtagggctccaaaagtattaatctcctcctcctgcctctacttcctccatcccttttagggtttcagggtcacagggcagtcaccagggctgtgatcctgagggtgagtgctccttacatgtggtgccccagacactttcctcatcttagtcctggccctggcagccactcctgcaactccgactgcacatgtgcaactgagttaatgagcagacgcagcccctgacactgtcacgttagtaggtagaaacacctggaaact

SEQ ID NO: 277287 - DNA, 494 bp, Homo sapiens
cctcaatttgcaattccatgattactactgaagtatattttcaaaagcctagtgagctttgaagtgtctagtcttaacttgtccacttgcccgtatacacaataacatcttttcctttgtcaggttaaccactcaggggttcagttttggtttattatcctaaaacatattttatccaatccaccgttgatgggcactgggattgattccatgtctttgctattgtgaacagtgctgtgatgaacatgagagttcatgtatctttttggtagaacaatttgttttcttttggatacatacctaataatgggattgctgagttgaatgatagctctgtctaagtactttgagaaactgcaaaactactttccacagtggctggacaaatttacacgcttaccaacagtgtgtaagcattcccttttctccacagcttcgccaacatctgttgttttttgactttttaataaacactattctgactggtgtgagat

SEQ ID NO: 277288 - DNA, 1339 bp, Homo sapiens
aaagtcctatcacagcgggaggggacgccagcgcctgcagaggctgagcagggaaaaagccagtgccccagcggaagcacagctcagagctggtctgccatggacatcctggtcccactcctgcagctgctggtgctgcttcttaccctgcccctgcacctcatggctctgctgggctgctggcagcccctgtgcaaaagctacttcccctacctgatggccgtgctgactcccaagagcaaccgcaagatggagagcaagaaacgggagctcttcagccagataaaggggcttacaggagcctccgggaaagtggccctactggagctgggctgcggaaccggagccaactttcagttctacccaccgggctgcagggtcacctgcctagacccaaatccccactttgagaagttcctgacaaagagcatggctgagaacaggcacctccaatatgagcggtttgtggtggctcctggagaggacatgagacagctggctgatggctccatggatgtggtggtctgcactctggtgctgtgctctgtgcagagcccaaggaaggtcctgcaggaggtccggagagtactgagaccgggaggtgtgctctttttctgggagcatgtggcagaaccatatggaagctgggccttcatgtggcagcaagttttcgagcccacctggaaacacattggggatggctgctgcctcaccagagagacctggaaggatcttgagaacgcccagttctccgaaatccaaatggaacgacagccccctcccttgaagtggctacctgttgggccccacatcatgggaaaggctgtcaaataatctttcccaagctccaaggcactcatttgctccttccccagcctccaattagaacaagccacccaccagcctatctatcttccactgagagggacctagcagaatgagagaagacattcatgtaccacctcctagtccctctctccccaacctctgccagggcaatctctaacttcaatcccgccttcgacagtgaaaaagctctacttctacgctgacccagggaggaaacactaggaccctgttgtatcctcaactgcaagtttctggactagtctcccaacgtttgcctcccaatgttgtccctttccttcgttcccatggtaaagctcctctcgctttcctcctgaggctacacccatgcgtctctaggaactggtcacaaaagtcatggtgcctgcatccctgccaagcccccctgaccctctctccccactaccaccttcttcctgagctgggggcaccagggagaatcagagatgctggggatgccagagcaagactc

SEQ ID NO: 277289 - DNA, 1285 bp, Homo sapiens
aaagtcctatcacagcgggaggggacgccagcgcctgcagaggctgagcagggaaaaagccagtgccccagcggaagcacagctcagagctggtctgccatggacatcctggtcccactcctgcagctgctggtgctgcttcttaccctgcccctgcacctcatggctctgctgggctgctggcagcccctgtgcatggagagcaagaaacgggagctcttcagccagataaaggggcttacaggagcctccgggaaagtggccctactggagctgggctgcggaaccggagccaactttcagttctacccaccgggctgcagggtcacctgcctagacccaaatccccactttgagaagttcctgacaaagagcatggctgagaacaggcacctccaatatgagcggtttgtggtggctcctggagaggacatgagacagctggctgatggctccatggatgtggtggtctgcactctggtgctgtgctctgtgcagagcccaaggaaggtcctgcaggaggtccggagagtactgagaccgggaggtgtgctctttttctgggagcatgtggcagaaccatatggaagctgggccttcatgtggcagcaagttttcgagcccacctggaaacacattggggatggctgctgcctcaccagagagacctggaaggatcttgagaacgcccagttctccgaaatccaaatggaacgacagccccctcccttgaagtggctacctgttgggccccacatcatgggaaaggctgtcaaataatctttcccaagctccaaggcactcatttgctccttccccagcctccaattagaacaagccacccaccagcctatctatcttccactgagagggacctagcagaatgagagaagacattcatgtaccacctcctagtccctctctccccaacctctgccagggcaatctctaacttcaatcccgccttcgacagtgaaaaagctctacttctacgctgacccagggaggaaacactaggaccctgttgtatcctcaactgcaagtttctggactagtctcccaacgtttgcctcccaatgttgtccctttccttcgttcccatggtaaagctcctctcgctttcctcctgaggctacacccatgcgtctctaggaactggtcacaaaagtcatggtgcctgcatccctgccaagcccccctgaccctctctccccactaccaccttcttcctgagctgggggcaccagggagaatcagagatgctggggatgccagagcaagactc

SEQ ID NO: 277290 - DNA, 260 bp, Homo sapiens
ccgcctgcagccaggccccgccccctgcaagccctcccgccccacagagcttcgccccctgcaggtccctcgcccactacaggcctccagacccgggcaggtccctcgcccctgcagcccctcgccccgcggaaccccaccccctacagcccccctggtcccgcagagccccgccccctgcaggctcccgcccccgcccgcaaggactcccaccaagcctccctacccaccacgcccctcccgcccccaccttgcggccg

SEQ ID NO: 277291 - DNA, 1008 bp, Homo sapiens
  misc_feature (8)..(9): n is a, c, g, or t
tggatccnncgggctgcaggaattcggcacgagaaaccttgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcatttattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaaggtgaagatgaggttcacttacatatatcatttaacatcagtgtaagatgcaattaaaatagatggaagacaagaagtcccttattagatgatgggtttggcaagacagttaacttttctacagatgttttatcacatagactatctgtcgaagcacataactggcataaaacctttgggttcattaaatgaatagagattctaatatgactggtatccatatctgatgtaaagaaactgcggccctggaaacatgaactacggtttcttgacaatatgagatgttaaaaataaaagttattgcttgaacctttggagcacttggactaaaggaaaccgtgactcttttgaa

SEQ ID NO: 277292 - DNA, 2140 bp, Homo sapiens
  misc_feature (8)..(9): n is a, c, g, or t
tggatccnncgggctgcaggaattcggcacgagaaaccttgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcattttaataaatttgaagtgaactgtcttataaagcttttttatgacttggtgggaggagtagagaggcaaggtctggttgttggactggatcgtaatgcatttcgaaacatcctgcatgtgacatttggaatgacagatgacatgattatggacagagtattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgagtaaaaaaggaggcacacacatattgcttattttttctacttagttcagaaaaatgatgttgaattgtgtgtttcagggtgaagatgaggttcacttacatatatcatttaacatcagtgtaagatgcaattaaaatagatggaagacaagaagtcccttattagatgatgggtttggcaagacagttaacttttctacagatgttttatcacatagactatctgtcgaagcacataactggcataaaacctttgggttcattaaatgaatagagagattacataattatgaattgttaatacaaatattctgcatgtcaaaaagaagctgggtgtacactgaaaaatcattgaaactactggatttcctttgaaacaaataatgaagatggcatcaaaagaataagagtattctattgagcattgaaacgcctttctggtaggcattgagggagatctagagagatgaaagatacatggaaatcatattatattgaaatataatatgatttgcattattgtttgaggctttggctaaataacgttactgattgtaagcacctgaaggcaagggttttatccaccacatctttgtctgccatagcatttagtcctctgcatacaatgggctgtccataattactgtagattggactgaaaatcaaaaagtaccacaagataaatgcaaactcttggtgagcagagggagaacatgtactgagtttcttaggtttcatggctaatgcattggcacagctttcagtgtatccctgcagtccttccagatagtccctgccccatgcattgcagatggttgccaaggcccccctctgtcctggcacccagtgttcctccatcctgactccacgtattgcccccttgccactgcctgagtgcaccatagtgtccccatccccccactgcctggagttccccttgtgtacccccttatcagggcacgacctaactgtgccctgctggctgtgacctcctgaagacagacctggcttctccctgcatccagttccccagtatgtgctgtgggcatcctgagaagcctgaaaaagacagggccaggttaggcttgggtgagctgctttctgccttcttggtacacacagtaagcagtggagaggcgtgttacaccgtatctgttctatcctcatctaaatactgagaggctagttgggatagtaaatctttcttactacatatgcattaagtttaagtaaaatagaatattgtgtgaaaaaatgcactgttactaataaatggaataaacagatccatgaaataaaagaaaacatattttactgtccaagtt

SEQ ID NO: 277293 - DNA, 2059 bp, Homo sapiens
  misc_feature (8)..(9): n is a, c, g, or t
tggatccnncgggctgcaggaattcggcacgagaaaccttgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcattttaataaatttgaagtgaactgtcttataaagcttttttatgacttggtgggaggagtagagaggcaaggtctggttgttggactggatcgtaatgcatttcgaaacatcctgcatgtgacatttggaatgacagatgacatgattatggacagagtattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaaggtgaagatgaggttcacttacatatatcatttaacatcagtgtaagatgcaattaaaatagatggaagacaagaagtcccttattagatgatgggtttggcaagacagttaacttttctacagatgttttatcacatagactatctgtcgaagcacataactggcataaaacctttgggttcattaaatgaatagagagattacataattatgaattgttaatacaaatattctgcatgtcaaaaagaagctgggtgtacactgaaaaatcattgaaactactggatttcctttgaaacaaataatgaagatggcatcaaaagaataagagtattctattgagcattgaaacgcctttctggtaggcattgagggagatctagagagatgaaagatacatggaaatcatattatattgaaatataatatgatttgcattattgtttgaggctttggctaaataacgttactgattgtaagcacctgaaggcaagggttttatccaccacatctttgtctgccatagcatttagtcctctgcatacaatgggctgtccataattactgtagattggactgaaaatcaaaaagtaccacaagataaatgcaaactcttggtgagcagagggagaacatgtactgagtttcttaggtttcatggctaatgcattggcacagctttcagtgtatccctgcagtccttccagatagtccctgccccatgcattgcagatggttgccaaggcccccctctgtcctggcacccagtgttcctccatcctgactccacgtattgcccccttgccactgcctgagtgcaccatagtgtccccatccccccactgcctggagttccccttgtgtacccccttatcagggcacgacctaactgtgccctgctggctgtgacctcctgaagacagacctggcttctccctgcatccagttccccagtatgtgctgtgggcatcctgagaagcctgaaaaagacagggccaggttaggcttgggtgagctgctttctgccttcttggtacacacagtaagcagtggagaggcgtgttacaccgtatctgttctatcctcatctaaatactgagaggctagttgggatagtaaatctttcttactacatatgcattaagtttaagtaaaatagaatattgtgtgaaaaaatgcactgttactaataaatggaataaacagatccatgaaataaaagaaaacatattttactgtccaagtt

SEQ ID NO: 277294 - DNA, 708 bp, Homo sapiens
  misc_feature (8)..(9): n is a, c, g, or t
tggatccnncgggctgcaggaattcggcacgagaaaccttgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcatttattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgagtaaaaaaggaggcacacaaaaaaaagaaaaaaacgtctccagcgctg

SEQ ID NO: 277295 - DNA, 940 bp, Homo sapiens
  misc_feature (8)..(9): n is a, c, g, or t
tggatccnncgggctgcaggaattcggcacgagaaaccttgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcattgtaagtaagaatgtagtgctggacaggccgaggctcctggaccgagcctgggtcccaccccgtgctaaggtccgctgttgtgcctgcttcccgcctgctgggactctgtgggctacctaccgcccctccaccccggccccttaagcagaagtcagagagggaatcccggggtgccagctccttgcgtttgatcttaggaacccaggcctccgcctctggtgctacctacactcccacacatgcatttacttgcttctccaaccctcttcttttacctgatagaaacatgtgatgttagcctcaatgaggtgtaaaataaatgctaaaaccaactggtctcaagaaaagtagcaccaccaaggtagaccgtgcactcaccctgctttatagctcgcacatacacccgcaggtccaagttctggaagcttaccaagagacccataggagaaaacggtgctcaacttctcaacatctttcggagagatgagttgtgtcatctcatctgtgcctcagaacaatagggttggaaccaagtcaccaactaacagtgtaagaaggtccacttgatccattcaggcctgctgtgagtaggaattggggaatatttccattagggcgtatattcgatgaggggctaatctggatggtttcggcaattgctcaggcggatgtaggaattggcgttataagtcagtcccagtggggcgtatttgtatttttattttttgtatt

SEQ ID NO: 277296 - DNA, 800 bp, Homo sapiens
  misc_feature (8)..(9): n is a, c, g, or t
tggatccnncgggctgcaggaattcggcacgagaaaccttgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcattgtccaagttctggaagcttaccaagagacccataggagaaaacggtgctcaacttctcaacatctttcggagagatgagttgtgtcatctcatctgtgcctcagaacaatatttgtttggaaaccagagttcagcacaactaaacacgtgactatgaactggctgtgagagaagagactcttctactggaggcctttgggccatgtcttcctgatccaaagctaggctcacagaggtccctggggtgagagattgtcagcgtggaggacatttggatgcactggttgaaacccaggctgccctctcctagcctgagctgcacctgcccacctcccatctgcatttccaaagcctcgtgtggatgaaggggacctaagcagcctgctccctgagggaggacaccaccacttggagccacacagcctgaagacagagaacagtgtggaaattgaggaaattggattttggaaaatcaggaacgtcctatgtgtctcaactagaaaagggcaaaagccaagattcagaccttatctagttctaatgctgaagacctttgtctaaagcaaatctgttctcgccacatatcctccac

SEQ ID NO: 277297 - DNA, 2028 bp, Homo sapiens
  misc_feature (8)..(9): n is a, c, g, or t
tggatccnncgggctgcaggaattcggcacgagaaaccttgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcattttaataaatttgaagtgaactgtcttataaagcttttttatgacttggtgggaggagtagagaggcaaggtctggttgttggactggatcgtaatgcatttcgaaacatcctgcatgtgacatttggaatgacagatgacatgattatggacagagtattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaagtgagtaaaaaaggaggcacacacatattgcttattttttctacttagttcagaaaaatgatgttgaattgtgtgtttcagggtgaagatgaggttcacttacatatatcatttaacatcagtgtaagatgcaattaaaatagatggaagacaagaagtcccttattagatgatgggtttggcaagacagttaacttttctacagatgttttatcacatagactatctgtcgaagcacataactggcataaaacctttgggttcattaaatgaatagagagattacataattatgaattgttaatacaaatattctgcatgtcaaaaagaagctgggtgtacactgaaaaatcattgaaactactggatttcctttgaaacaaataatgaagatggcatcaaaagaataagagtattctattgagcattgaaacgcctttctggtaggcattgagggagatctagagagatgaaagatacatggaaatcatattatattgaaatataatatgatttgcattattgtttgaggctttggctaaataacgttactgattgtaagcacctgaaggcaagggttttatccaccacatctttgtctgccatagcatttagtcctctgcatacaatgggctgtccataattactgtagattggactgaaaatcaaaaagtaccacaagataaatgcaaactcttggtgagcagagggagaacatgtactgagtttcttaggtttcatggctaatgcattggcacagctttcagtgtatccctgcagtccttccagatagtccctgccccatgcattgcagatggttgccaaggcccccctctgtcctggcacccagtgttcctccatcctgactccacgtattgcccccttgccactgcctgagtgcaccatagtgtccccatccccccatatgtgctgtgggcatcctgagaagcctgaaaaagacagggccaggttaggcttgggtgagctgctttctgccttcttggtacacacagtaagcagtggagaggcgtgttacaccgtatctgttctatcctcatctaaatactgagaggctagttgggatagtaaatctttcttactacatatgcattaagtttaagtaaaatagaatattgtgtgaaaaaatgcactgttactaataaatggaataaacagatccatgaaataaaagaaaacatattttactgtccaagtt

SEQ ID NO: 277298 - DNA, 1903 bp, Homo sapiens
  misc_feature (8)..(9): n is a, c, g, or t
tggatccnncgggctgcaggaattcggcacgagaaaccttgagacctcaccgcgttgacccagcaccagggctcgcgggggtcccgcgagggtctcggtagccgcgcgcccagagacccccgccgcggcccgattctctgagcgccagacatgaaccgcaagaaactgcagaagctgacggacaccttaaccaaaaattgcaagcatttattccgaggttttgataaagataatgatggctgtgtaaatgtattggagtggattcatggattatcactgtttcttcgaggatctttggaagaaaaaatgaaatattgctttgaagtgtttgatttgaatggtgacggattcatttcaaaggaggaaatgtttcacatgttgaagaacagccttctcaaacagccatctgaggaagaccctgatgaaggaattaaagatttggttgaaataacactgaagaaaatggatcatgaccatgatgggaagctgtcttttgcagactatgaactggctgtgagagaagagactcttctactggaggcctttgggccatgtcttcctgatccaaagagccagatggaatttgaagctcaagtattcaaagatccaaatgaattcaatgatatgtgaataactaaatgtctatattgtctcaaggtgaagatgaggttcacttacatatatcatttaacatcagtgtaagatgcaattaaaatagatggaagacaagaagtcccttattagatgatgggtttggcaagacagttaacttttctacagatgttttatcacatagactatctgtcgaagcacataactggcataaaacctttgggttcattaaatgaatagagagattacataattatgaattgttaatacaaatattctgcatgtcaaaaagaagctgggtgtacactgaaaaatcattgaaactactggatttcctttgaaacaaataatgaagatggcatcaaaagaataagagtattctattgagcattgaaacgcctttctggtaggcattgagggagatctagagagatgaaagatacatggaaatcatattatattgaaatataatatgatttgcattattgtttgaggctttggctaaataacgttactgattgtaagcacctgaaggcaagggttttatccaccacatctttgtctgccatagcatttagtcctctgcatacaatgggctgtccataattactgtagattggactgaaaatcaaaaagtaccacaagataaatgcaaactcttggtgagcagagggagaacatgtactgagtttcttaggtttcatggctaatgcattggcacagctttcagtgtatccctgcagtccttccagatagtccctgccccatgcattgcagatggttgccaaggcccccctctgtcctggcacccagtgttcctccatcctgactccacgtattgcccccttgccactgcctgagtgcaccatagtgtccccatccccccactgcctggagttccccttgtgtacccccttatcagggcacgacctaactgtgccctgctggctgtgacctcctgaagacagacctggcttctccctgcatccagttccccagtatgtgctgtgggcatcctgagaagcctgaaaaagacagggccaggttaggcttgggtgagctgctttctgccttcttggtacacacagtaagcagtggagaggcgtgttacaccgtatctgttctatcctcatctaaatactgagaggctagttgggatagtaaatctttcttactacatatgcattaagtttaagtaaaatagaatattgtgtgaaaaaatgcactgttactaataaatggaataaacagatccatgaaataaaagaaaacatattttactgtccaagtt

SEQ ID NO: 277299 - DNA, 581 bp, Homo sapiens
actttatacaagtgtttagacacttcgccagcagccttggttttcagagagaaaaataaaataaaaacagcacttaattaaaatggagcgtgaaacccagaaggaatcatggtgtgtgagtgcttagagtgttacagttcccacccattgtttggaatttgcatcttaattcaatataaagcctgacaataggtacagcaaagagacgaatcaagacttgggtctcacagaagttacctggtgccaacatcccacgcaccatcgtggagactggctggatgccctgtgctctatcagggcatgtcagaccaacagaggggcaaatcagagtgaagaggaagccagaagatgggagagacatttttgaaggaacaagctgccaataatgtctgcaaaaagtgaattcttccaacaactacgtgagcttggaagaggaccttgaacctagaatgagactgcagcagccccagccaacacccttctcagcttcgtggaccctgagcagagaacacagcaaatttgtccagacttctcatctacagaaactgagataataaatgattgttgttttaacatcccta

SEQ ID NO: 277300 - DNA, 521 bp, Homo sapiens
tttttgagacagagtcttgctctgtcacccaggctggaatgcagtggcggaatctcagctcactgcaaactccgcctcccaggttcaagcgattctcctgcctcagcatccggagtagctgggactagaggcgcccgccaccacgcccggctaattttttgtgttttcagtagagacagggtttcaccgtgttagccaggatggtctcgatctcctgaccttgtgatctgcctgcctcggcctcccaaagtgctgggattacaggcgtgagccaccgcgcctggccaattttctcacataagttggcaggaacaagctgccaataatgtctgcaaaaagtgaattcttccaacaactacgtgagcttggaagaggaccttgaacctagaatgagactgcagcagccccagccaacacccttctcagcttcgtggaccctgagcagagaacacagcaaatttgtccagacttctcatctacagaaactgagataataaatgattgttgttttaacatcccta

SEQ ID NO: 277301 - DNA, 364 bp, Homo sapiens
tgaggcctccccagctgcatggaactccaacatcccacgcaccatcgtggagactggctggatgccctgtgctctatcagggcatgtcagaccaacagaggggcaaatcagagtgaagaggaagccagaagatgggagagacatttttgaaggaacaagctgccaataatgtctgcaaaaagtgaattcttccaacaactacgtgagcttggaagaggaccttgaacctagaatgagactgcagcagccccagccaacacccttctcagcttcgtggaccctgagcagagaacacagcaaatttgtccagacttctcatctacagaaactgagataataaatgattgttgttttaacatcccta

SEQ ID NO: 277302 - DNA, 367 bp, Homo sapiens
caggcttggaggctgggaggtctaacattaaggtgccagcatctggtgagggcctttttgctaagtcatctcatggtggaacgtggaagggcaaaagagcatcagagaatgcatgcacatgagagacgggggaccaaactcattcttttatcagggaacaagctgccaataatgtctgcaaaaagtgaattcttccaacaactacgtgagcttggaagaggaccttgaacctagaatgagactgcagcagccccagccaacacccttctcagcttcgtggaccctgagcagagaacacagcaaatttgtccagacttctcatctacagaaactgagataataaatgattgttgttttaacatcccta

SEQ ID NO: 277303 - DNA, 1295 bp, Homo sapiens
  misc_feature (1044)..(1044): n is a, c, g, or t
  misc_feature (1100)..(1100): n is a, c, g, or t
  misc_feature (1103)..(1103): n is a, c, g, or t
ttacagaggttatgtttcctccgaggagccagctatgaactgcttctccataagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgctttgttcccaagtgtgaccctaaacttaagcttgtaggagttgacattctttcatgtcccttccctttactcatgccgaaactatcaactgggacatttgtgctttggtttaaaagttaattgatattatacttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagcctgttataccattgtcatggacncctgtcataaagccatttcttggtttgttgggaaagaggcatatgggattatacanatncactgtaaatgtcggatggggattttggtaaattttctccaattaaggctaagcagaaaccaaaaaaaaaaagaagtaggagagaaagaaaagaaaagagatagagagagaaaaaggacaggaataaacaacaaaaaaaaagagggggggatataatacgggggggaaagagagaacatgaagaagcaatag

SEQ ID NO: 277304 - DNA, 1437 bp, Homo sapiens
ccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaatacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcatttta

SEQ ID NO: 277305 - DNA, 1452 bp, Homo sapiens
ccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcatttta

SEQ ID NO: 277306 - DNA, 767 bp, Homo sapiens
actcaaaaaaaaaaaaaagaagtttgttgctatggaagggtcctactcagagcaggcaccccagttaatctcattcaccccacatttcacatttgaacatcatcccatagcccagagcatccctccactgcaaaggatttattcaacatttaaacaatcctttttactttcattttccttcaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcatttta

SEQ ID NO: 277307 - DNA, 1712 bp, Homo sapiens
  misc_feature (1461)..(1461): n is a, c, g, or t
  misc_feature (1517)..(1517): n is a, c, g, or t
  misc_feature (1520)..(1520): n is a, c, g, or t
ccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgctttgttcccaagtgtgaccctaaacttaagcttgtaggagttgacattctttcatgtcccttccctttactcatgccgaaactatcaactgggacatttgtgctttggtttaaaagttaattgatattatacttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagcctgttataccattgtcatggacncctgtcataaagccatttcttggtttgttgggaaagaggcatatgggattatacanatncactgtaaatgtcggatggggattttggtaaattttctccaattaaggctaagcagaaaccaaaaaaaaaaagaagtaggagagaaagaaaagaaaagagatagagagagaaaaaggacaggaataaacaacaaaaaaaaagagggggggatataatacgggggggaaagagagaacatgaagaagcaatag

SEQ ID NO: 277308 - DNA, 1506 bp, Homo sapiens
ccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcatttta

SEQ ID NO: 277309 - DNA, 1082 bp, Homo sapiens
agctgtgctgtcagctcacccctgcgctcgctcccctccggcacaggcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcatttta

SEQ ID NO: 277310 - DNA, 1315 bp, Homo sapiens
ccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaaacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcatttta

SEQ ID NO: 277311 - DNA, 1126 bp, Homo sapiens
ccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattgttattgttaaatctttttttgtttgtttggttggttggctctcttctgcaaaggacatcaa

SEQ ID NO: 277312 - DNA, 621 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaagggctatggcaaggatgctgctggcattgccatggaagccattgcttttggtacagtgcatgggaag

SEQ ID NO: 277313 - DNA, 2956 bp, Homo sapiens
aaagtcctagctggtaccggtcggagtcctagatcagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277314 - DNA, 3404 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgccaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaacttgcgcccgaatttgggcctcattggccaaattccccttatggggggccgattaacaatcaatggcccgcggtttaacacggtcggaatgggaaaaccctgggggttcccaaattaaacgccttggaagaaaatccccttttcgcaagtgggcgaaaaaccaaagagccccccccggatggcctttccaaacagtggcccacccttgatggccatgggaaattgaagccgttaatatttggtattccgcgtataatttttggtcagccaattttttccc

SEQ ID NO: 277315 - DNA, 2807 bp, Homo sapiens
  misc_feature (761)..(762): n is a, c, g, or t
  misc_feature (764)..(764): n is a, c, g, or t
  misc_feature (784)..(784): n is a, c, g, or t
  misc_feature (791)..(791): n is a, c, g, or t
agttctacatcgctgagccggccacccttatctatatcaactcatgaagcttccctcctacatgttagtcatcttcaacaatttctaacttctatctgactatgctagaaatcgcatgttcgctcttaattccaatgcctagcgtttttcgacaactatctatgttaatgcctctagcctgtcgacgacaactagcattaacaaaacaaacacagagaagataatgaaatagaccataacaacacacatcacaaaaaaaagcaataaatgagaccagcgagccagtggtgcagatgtttgcacccagggcgtatggcaaggatgctgctggcagttgcccattggaagccatggctctcttgcacgtaaccaaggctttgacgtggtgcgtggtggacacggcaggccgcatgcaagacaaatgcccctctgatgactgccctggccaaactcattactgtcagagtaccagcctgatttggtgctgtatgtagagagaagccttagtaggcacatgaagccgtggaccagctggtcaagttcaacagagcctatggctgaccattctatggctcagacacctcggctcattgatggcattgttcttaccaaatttgataccatggatgaccaaaggtgggaagctgctatttctatgacgtacatcacaagcaaaccatcgtctaatgtgggcaccggcagacctactgtgactacgcagctcaatgccaaggctgtggtggctgccctcatgaaggctnnangtggctcttgccaataccanatcgccnctttccccacaagcccttcttcctgtatctaaactcgaccaaaccttgtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277316 - DNA, 3693 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgccttttaggtcttggagttcttttatacaggattcaaaactaaaattccacaacacacttaactgtagttctaggacatatgtatggtcaggacaacagagcagaagttgataatgctccgaggaatcaggtaagtaaacggttgtcctgagaatgagatcactccaccccaaggagaaagatcggaacctttaaactttgggttattaaaattaagcttattagtaccttgatgcaagttagagtttcttacaatgactctaaaagtagagccagggtcctggcaagtaaatgaacaagcttttaatacagcttagttatgtaaaatactgtacactgtaaaagatctagaaaactagagcttcaagtcatgttttaaaaaagccattaagcttaattgaaaaaccaagtatagagtacaaaactgcaacaagagccacagtgattccatggcatccagaccccgagtccttcatgcagagctgcagccggtcagtggaagtatcacattggtgtgctgtgtggacacaagcatgtctagcctggggagtgggttgggagctgcatttgggtcctgcttgtcgcttttattcttgaacttgaacaggcggcagaatatcaagaaccaggtggtatgaaggattacgctgcaacattcccccctcttctacc

SEQ ID NO: 277317 - DNA, 1329 bp, Homo sapiens
cggacgcgtgggtcgacccacgcgtcctgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277318 - DNA, 1285 bp, Homo sapiens
cggacgcgtgggtcgacccacgcgtcctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277319 - DNA, 3655 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccccatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgccttttaggtcttggagttcttttatacaggattcaaaactaaaattccacaacacacttaactgtagttctaggacatatgtatggtcaggacaacagagcagaagttgataatgctccgaggaatcaggtaagtaaacggttgtcctgagaatgagatcactccaccccaaggagaaagatcggaacctttaaactttgggttattaaaattaagcttattagtaccttgatgcaagttagagtttcttacaatgactctaaaagtagagccagggtcctggcaagtaaatgaacaagcttttaatacagcttagttatgtaaaatactgtacactgtaaaagatctagaaaactagagcttcaagtcatgttttaaaaaagccattaagcttaattgaaaaaccaagtatagagtacaaaactgcaacaagagccacagtgattccatggcatccagaccccgagtccttcatgcagagctgcagccggtcagtggaagtatcacattggtgtgctgtgtggacacaagcatgtctagcctggggagtgggttgggagctgcatttgggtcctgcttgtcgcttttattcttgaacttgaacaggcggcagaatatcaagaaccaggtggtatgaaggattacgctgcaacattcccccctcttctacc

SEQ ID NO: 277320 - DNA, 1081 bp, Homo sapiens
gcgggggttcctggcagagcgtgggttccttgcagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277321 - DNA, 2972 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaattcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277322 - DNA, 2739 bp, Homo sapiens
  misc_feature (2737)..(2737): n is a, c, g, or t
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactctagttggggatactctagagcggncc

SEQ ID NO: 277323 - DNA, 2054 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtggtccacggcttcattgcctactaaggcttctcctacaaacaggaccaaatcaggtgtattgacagtcatgagtatggccagggcagtcatcacaggggcattgtcttgcatgcggtctgccgtgtccaccagtgcatcca

SEQ ID NO: 277324 - DNA, 1643 bp, Homo sapiens
  misc_feature (1643)..(1643): n is a, c, g, or t
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattggctaagaacgtggctgccgaccattgcccgttcccaggctctgctggactcttgacgaccaaacaaagttgggacagggaacgtgactgcgggaacgttaccgcacccggtgcacatccacagacaaaccaagccctagcaggagttccctgagatgacacaattcctgcaaggccacacaggtccgttgctaagaacaggtggcatccagggggacactcgaatgggaatagcccccagcatgcatcagcacaagaaggccctattaaatagtccgagaccacccacttccggagccagacgcactacaacttggaacagctgcgagggaacaagttctacacagtaaaagcacttgagcaacagagtagctcccacattactaagagctaccgataacgcagcgaaagtcggggcttcgaaagcaggacaacaccactacgttggcacgcgcctagggtggcgaaan

SEQ ID NO: 277325 - DNA, 886 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcggtgagagacctgccttctctaaaatcaatttatttccatgatttgatgacctctctgaaggtggttcaaaggtggtaaattgatgtgttcaaagacattcctaatttgctacccagttctcattgtcctcttgggtgtgagagtcctttctctggaccgttatttttccttctgcatggggtagaaagataaaccattctcctttttgtttagtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggcaagtttgagttctttggatata

SEQ ID NO: 277326 - DNA, 550 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagggagcagtaagatacatgctcagccacgcgatgggatcctctaagtcgcgcaga

SEQ ID NO: 277327 - DNA, 466 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatattacagatgtgctattagtgcaataaggtgaaggctgtctgcccagagaaataagtaatttatataagaaaataaatttcataaataaattgcc

SEQ ID NO: 277328 - DNA, 478 bp, Homo sapiens
catctttttcccccaacttggttatcttatttctggtggaatgccagagagaagtgccccaacatcctcttgtcctggggacagatttgagtttgggggaaatgtttggctctttcccaaaggttatccaaacccagggcccaaacctgggttttctggggatagtctgaacactgagacatactctttctccaggaacggggaggtaacaactccttcacccatgaggcactcacactcaagtataaactggacaaccagtttgagctggtgtttgtggtaagtggggtgttgtagagggacgattgcattgttaacatagccctgatttttaagagaactctgattaattgcagccagtgtatatgatgacgtaactgaaaaaactagaaaggtagatgggggaaaacagcagctactgggcccaggcagggagcttggctgcctctcaggacagggaaaccggccaggtagctga

SEQ ID NO: 277329 - DNA, 487 bp, Homo sapiens
tatactgggacatgaaaggtgttaacacggtgctaaggactgaggtggtccttccttttgtcattgcttacctgcttctcactcaaatggtcaccatcctataatccccaggccttatgaactccaagatgtttggtccaaatttcctttgaacaatttggaagacttttagccattgtctagtggttgggattggtcttcttttttcttcagtgagttttttccccaacaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaagtgagcactctttctccagtactctcaaaatactgttatctagacacaatgggtgcaagggagttctggtctctggctcatgtttcctttcctac

SEQ ID NO: 277330 - DNA, 333 bp, Homo sapiens
cagagacctagtgttcctgacccacatcctttccccgtatctccagattcgagggactgggtctggggggcagcttcaggatctggactgcagcagctctgatgacgaaggggctgctcaaaactctaccaaacctaggtaggggaatttcaggtgggggttggtatatgcatctgcaaaactggtaagatacaactcctgcctactggttttatgtgtatgtgtaatctcctgtccctgcagtgcgaccaagggaacactgggtggcatgtttggtatgctgaagggccttgtgggttcaaagagcttgagtcgtgaagacatggaatctgt

SEQ ID NO: 277331 - DNA, 660 bp, Homo sapiens
gaggctggaatgggcgtcctgcacaaaggagctgaggctgcaaggaaatcttggctccagcgcttcctgttcctgagagggtgagtgaaaagtgggcttgtgttgatgggctgtcctctttctccacttaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagc

SEQ ID NO: 277332 - DNA, 3023 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277333 - DNA, 321 bp, Homo sapiens
tcgactcttgagtatcccggttcattgctgataccagccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcctgttataatcgcgtagacaagtgaccggg

SEQ ID NO: 277334 - DNA, 2859 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277335 - DNA, 3236 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcggtgagagacctgccttctctaaaatcaatttatttccatgatttgatgacctctctgaaggtggttcaaaggtggtaaattgatgtgttcaaagacattcctaatttgctacccagttctcattgtcctcttgggtgtgagagtcctttctctggaccgttatttttccttctgcatggggtagaaagataaaccattctcctttttgtttagtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277336 - DNA, 2040 bp, Homo sapiens
gagaaagtgcttatgtgtaggttaagtgcatagacctcagttcttactaggtatgtgactttcggcaaattccttaacctctaaacctctgtaacctagattttaagggttattgagaggattcagtgagttagtccttgtaatgtgcgtctgttctggatttctgggacaagagtctaatttactgttttagtccccttagctcagaaaggtgttaggcatttttgagagcattccttgagtttcacagctgcaacctcctccacctcccctttcagcggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277337 - DNA, 3056 bp, Homo sapiens
  misc_feature (3048)..(3048): n is a, c, g, or t
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtcgagagggctggggtgctccttcgtctctcagctctcactagcaccatcccctcacagagcanagaatggg

SEQ ID NO: 277338 - DNA, 1423 bp, Homo sapiens
cttccggagcccagctccatgctaacctgcccacattgcccacgcgtccacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277339 - DNA, 3016 bp, Homo sapiens
  misc_feature (3002)..(3002): n is a, c, g, or t
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgcaaaacacaacatcagatgaagaaaacacaacagcgaactaagaaaacacaacgcaaatctnataaaacacataca

SEQ ID NO: 277340 - DNA, 1346 bp, Homo sapiens
tacggggaggcgggggcccggccgaggggctgccgaccaagcggcggcgcggggacacggcggccgcagcagacaagcccccgagacgcccggcaaccacgcaacccgagggcggcgggcagccagaggcagccgccgggaccgcgggcagcacagagccggcgaccaccaggccagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277341 - DNA, 3081 bp, Homo sapiens
  misc_feature (3080)..(3080): n is a, c, g, or t
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgcaacacggtctctcatgagagacccagcctctacagaaaaatttaaaaattagccaggcatggtggcatacatctgtagtcccagctacttgggagcctaaggtgggaggatcgcttgagcccaggacgttgaggctgcagtgagccatgttcatgccacttcactccagcgtgatacatgcaacacgtctctna

SEQ ID NO: 277342 - DNA, 1234 bp, Homo sapiens
tgctacatgaacacagacacatgcaggtgctttgcagaaacaaagtcaggcttcttcaagtcacaaagggaagggcaggaacaactcttgctctcagtcccacacaaggcagctgtctcacggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccactcccagaatccagaagtaagctctgcatgttccccttcctgggaggaaaccaattgtcagaaggatgtatgatgaccccctcccctcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277343 - DNA, 3602 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgccttttaggtcttggagttcttttatacaggattcaaaactaaaattccacaacacacttaactgtagttctaggacatatgtatggtcaggacaacagagcagaagttgataatgctccgaggaatcaggtaagtaaacggttgtcctgagaatgagatcactccaccccaaggagaaagatcggaacctttaaactttgggttattaaaattaagcttattagtaccttgatgcaagttagagtttcttacaatgactctaaaagtagagccagggtcctggcaagtaaatgaacaagcttttaatacagcttagttatgtaaaatactgtacactgtaaaagatctagaaaactagagcttcaagtcatgttttaaaaaagccattaagcttaattgaaaaaccaagtatagagtacaaaactgcaacaagagccacagtgattccatggcatccagaccccgagtccttcatgcagagctgcagccggtcagtggaagtatcacattggtgtgctgtgtggacacaagcatgtctagcctggggagtgggttgggagctgcatttgggtcctgcttgtcgcttttattcttgaacttgaacaggcggcagaatatcaagaaccaggtggtatgaaggattacgctgcaacattcccccctcttctacc

SEQ ID NO: 277344 - DNA, 2932 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcctcactgtggcagtgtattgcctgttaattgctgctaattctaattctgatgatgactcctactccattgtttaccccaaagcatcagctaggctggagtgatttgttacaaatgagcaaaagatgagtccttgcttccctcagaaataaaaggagctcagctgcagcgttgcattgggcttcttggcctcccaactcttcccatccttcacctcctaagcagtcctggcttttcctcatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277345 - DNA, 2206 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtcaagttcaacagagccttggctgaccattctatggctcagacacctcggctcattgatggcattgttcttaccaaatttgataccattgatgacaaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtggggttggaaggagccacaagccccctcactctgcctttgtactacactg

SEQ ID NO: 277346 - DNA, 1899 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaaggggctgctcaaaactctaccaaacctagtgcgaccaagggaacactgggtggcatgtttggtatgctgaagggccttgtgggttcaaagagcttgagtcgtgaagacatggaatctgtgctggacaagatgcgtgatcatctcattgctaagaacgtggctgcagacattgccgtccagctctgtgaatctgttgccaacaagttggaagggaaggtgatggggacgttcagcacggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttgcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctgcatcaatggtatcaaatttggtaagaacaatgccatcaatgagccgaggtgtctgagccatagaatggtcagccaagctctgttgaa

SEQ ID NO: 277347 - DNA, 1161 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaacaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctgattcgagggactgggtctggggggcagcttcaggatctggactgcagcagctctgatgacgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277348 - DNA, 1308 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgacatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgccttttaggtcttggagttcttttatacaggattcaaaactaaaattccacaacacacttaactgtagttctaggacatatgtatggtcaggacaacagagcagaagttgataatgctccgaggaatcaggtaagtaaacggttgtcctgagaatgagatcactccaccccaaggagaaagatcggaacctttaaactttgggttattaaaattaagcttattagtaccttgatgcaagttagagtttcttacaatgactctaaaagtagagccagggtcctggcaagtaaatgaacaagcttttaatacagcttagttatgtaaaatactgtacactgtaaaagatctagaaaactagagcttcaagtcatgttttaaaaaagccattaagcttaattgaaaaaccaagtatagagtacaaaactgcaacaagagccacagtgattccatggcatccagaccccgagtccttcatgcagagctgcagccggtcagtggaagtatcacattggtgtgctgtgtggacacaagcatgtctagcctggggagtgggttgggagctgcatttgggtcctgcttgtcgcttttattcttgaacttgaacaggcggcagaatatcaagaaccaggtggtatgaaggattacgctgcaacattcccccctcttctacc

SEQ ID NO: 277349 - DNA, 638 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgacatcactcccctctacagtgcctggtagacaagtgctacattgaagaacacaaacctcttgttaagacttgtcctgtagcttgatattacagatgtgctattagtgcaataaggtgaaggctgtctgcccagagaaataagtaatttatataagaaaataaatttcataaataaattgcc

SEQ ID NO: 277350 - DNA, 550 bp, Homo sapiens
gtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccattttctccaagggcgggcttgtgctctggtgcttccagggcgttagcgactcatgcaccggacccgttaacgcgttgattcgttccgtgctgctgcaggaacggggaggtaacaactccttcacccatgaggcactcacactcaagtataaactggacaaccagtttgagctggtgtttgtggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcgtgaagcagaggagagcagtaagatccgtgctcctgttataatcgcgtagacaagtgaccggg

SEQ ID NO: 277351 - DNA, 698 bp, Homo sapiens
gtcctcctctttctcctgccagcttcccaagcgctcgctcgacccgaagtccactctgctgctctcgctctcctctgggggcagctctgcggactggattcccatagcctcagagaggcggggccttgagccagctgcgggtccttccaggatggggcaagggacccgaaatgcactcccaacaggcatggcctggagaccctcagcgaagagtcctctcttcccttaaccaggttaactctccttacctccaccagtgagcctgagaacattcacctcccttagctgcatggagcccttaagctcctctaactgggtcagcattcctcaatacgtggctcccagttctgagcctgcacctccagctgtggccggagcactgccaacaactgcaccaatatcacctctctggctctggattcctacctctattaatacagccaaaagcttcactcaatgttggctcatagggaattaagggtcaaaaagccccaggtcatttccaggtcagtagttgtcagagggcccctgtcctagctctacttatgcaattggtgttttcagccttaaaaaaatggtcgactattgaaatcaatcctttaaaattttatctgctagtttcagcctgccattggttggcttgcagagtatttatttggccttctgcctcccgtgaaatgggaacttcctttagaatg

SEQ ID NO: 277352 - DNA, 787 bp, Homo sapiens
gtcctcctctttctcctgccagcttcccaagcgctcgctcgacccgaagtccactctgctgctctcgctctcctctgggggcagctctgcggactggattcccatagcctcagagaggcggggccttgagccagctgcgggtccttccaggatggggcaagggacccgaaatgcactcccaacaggcatggcctggagaccctcagcgaagagtcctctcttcccttaaccaggttaactctccttacctccaccagtgagcctgagaacattcacctcccttagctgcatggagcccttaaggtgcagagacagtcatcctgttctcccacaccccttcctatcctggggactcctacccacctggtgccttctttctctattttcctcagctcctctaactgggtcagcattcctcaatacgtggctcccagttctgagcctgcacctccagctgtggccggagcactgccaacaactgcaccaatatcacctctctggctctggattcctacctctattaatacagccaaaagcttcactcaatgttggctcatagggaattaagggtcaaaaagccccaggtcatttccaggtcagtagttgtcagagggcccctgtcctagctctacttatgcaattggtgttttcagccttaaaaaaatggtcgactattgaaatcaatcctttaaaattttatctgctagtttcagcctgccattggttggcttgcagagtatttatttggccttctgcctcccgtgaaatgggaacttcctttagaatg

SEQ ID NO: 277353 - DNA, 436 bp, Homo sapiens
ccccggaacttcctagacgccgtacgtgccagatggtgttacctggagcttaaaaagctgcacgcaagtgttaaacttctgaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttataca

SEQ ID NO: 277354 - DNA, 646 bp, Homo sapiens
  misc_feature (367)..(367): n is a, c, g, or t
aagctcggtacccattggtccgagagaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaatttctctcggaccaatgcattgntccgagagaaattagtcgcggtcaatgcaattctactctttggaatccgtttagctaaatgaatgtagtgctcttgttgaatggaaacaggtgataggaaatgcctaccatttgactcaatatggataatcaagagttgctcaggatgcttggatctgggggtagattctcattcatcattgcatggcacatgtcaattagaacataaaaggtcaaatgcaatgtcaaaatccaaagcctcaggagaaagtgagttcagttctccatagacagcatagt

SEQ ID NO: 277355 - DNA, 660 bp, Homo sapiens
ccccggaacttcctagacgccgtacgtgccagatggtgttacctggagcttaaaaagctgcacgcaagtgttaaacttctgaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaaaaaaaaaaaaaaaaaaaaaaaaaaaaaaaaaaaaaaaaaaaaaacaaaaaaaaagaaaaaatttgaaatctggttaggctggtgttagggttctttgtttttggggtttggcagagatgtgtttaagtgctgtgaccagaagcggggggagggggggtttggtggaaattttttgttatgatgtctgtgtggaaagcggctgtgcagacattcaattgttatt

SEQ ID NO: 277356 - DNA, 564 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaagaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttataca

SEQ ID NO: 277357 - DNA, 477 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcaaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttataca

SEQ ID NO: 277358 - DNA, 665 bp, Homo sapiens
  misc_feature (505)..(506): n is a, c, g, or t
  misc_feature (511)..(511): n is a, c, g, or t
  misc_feature (514)..(514): n is a, c, g, or t
ccccggaacttcctagacgccgtacgtgccagatggtgttacctggagcttaaaaagctgcacgcaagtgttaaacttctgtaggaggaatactgttggcgttcaaaagcattgctgtttcaaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaaaaaaaaaaaggcaacaacaaaaaaaannctttnggngccgccttgggcgcttgaaaaagttttcttaaaccattcggtttgggcggcggggccccagttagggttacgttgacctggcgctcatacgcgtgttccctaggagactactgcgccatgacctagtgctgggatttcctctccatttaac

SEQ ID NO: 277359 - DNA, 1473 bp, Homo sapiens
ctttaattaaaatctgacactgctgacctggagatagcgtcagattccacaggttgagagttgagtcctaagcctctccccaacttccagtgacaatcacaagtcccagatgttttacctgtgcttctcaccaaccagttataaataagtgttcccatgaccccctccttgggtttgattaatttgctagagcagctcacagaacccaggaaaatacttttaccagtttattataaaggatattacaaaggggacagatgcgtagccagatggaagaggtgcagagggcaaggtacatgggaaggggcatggagcttccctgctctctctgggcatgccactttctaggagcccccatgtgttcagctatccagaagctctttgaacccagttcttttgtagatttccggaggcttcattatgtaggcataattcattaaatcattggccattagtgatgggcttaacctttatccccactcctctggagcagaaagtcctaatcctctaaccctgtgtttttatctgactagccctcctcctgaagctatctagagactcccagctaccagccatcttattagcattcaaaagacactcttatccctcttaatacaatgatttaaaaagctgtatgacaggaaatgaggacaaagaccaaatatatatatatatcttattatgaatcacaatatcacagtcacatattttagccttctgaaccataagtgtgaggcatagccacataaatcccattttttaaaaaccaaaactttttgtctgtaatttcccaataagactataagaatttttgagtgaattatccctaatttgttggtaagagtttttagattttagatttaacaggttaaggttgaatatatcttatctttaatggttatgagatcatagattaatgctttttttctttttaaaagataaacattatgaatgaggaaaaagttaacagagtaaataaagcttttgtaaatgtacaaaaggaacttgcacatttcgcaaaaagcatttcacttgaacctctgcagaaagaactggtaagcagaaatcatttgcttttttttatggctaacaaattgaggctaataaattaaactcccaagttttcaaagcctgtaagttgagtgtaatttttagtacttggctctctagtactaggctctatagtataaatagcatattcagactctaaaacattgtcagaatatacagattgttctacttccaaagatatgactagaaaaattaaattgaataacagcttatataagtcatttgtctgctattgttgtctgtgtttttaaatataatactttctcctttcagattcctcagcagcgtcatgaaagcaaaccagttaatgttgatgaagctacaagattaatggctctgttgtaatatactggtgatgcatctaattctccacaaagaccaataaattgaatgttttataca

SEQ ID NO: 277360 - DNA, 1184 bp, Homo sapiens
ctttaattaaaatctgacactgctgacctggagatagcgtcagattccacaggttgagagttgagtcctaagcctctccccaacttccagtgacaatcacaagtcccagatgttttacctgtgcttctcaccaaccagttataaataagtgttcccatgaccccctccttgggtttgattaatttgctagagcagctcacagaacccaggaaaatacttttaccagtttattataaaggatattacaaaggggacagatgcgtagccagatggaagaggtgcagagggcaaggtacatgggaaggggcatggagcttccctgctctctctgggcatgccactttctaggagcccccatgtgttcagctatccagaagctctttgaacccagttcttttgtagatttccggaggcttcattatgtaggcataattcattaaatcattggccattagtgatgggcttaacctttatccccactcctctggagcagaaagtcctaatcctctaaccctgtgtttttatctgactagccctcctcctgaagctatctagagactcccagctaccagccatcttattagcattcaaaagacactcttatccctcttaatacaatgatttaaaaagctgtatgacaggaaatgaggacaaagaccaaatatatatatatatcttattatgaatcacaatatcacagtcacatattttagccttctgaaccataagtgtgaggcatagccacataaatcccattttttaaaaaccaaaactttttgtctgtaatttcccaataagactataagaatttttgagtgaattatccctaatttgttggtaagagtttttagattttagatttaacaggttaaggttgaatatatcttatctttaatggttatgagatcatagattaatgctttttttctttttaaaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttataca

SEQ ID NO: 277361 - DNA, 467 bp, Homo sapiens
ccattggtcgagagaaattaggaatcagtacttttcatctttatcggtcaactgtcgaccttatgtagtgcgcgttgtccttgttgcacgatcagtgccagtgcatccaccttgttgccgttgatcatcacatctcagtttctagtagattagccgattgataacggtcaaaatggtaatccagcgaagcatagctaatttctctcggaccaatgcattggtccgagagaacagacaaattaagagggccgaagtccaggaatgtatttcacatagccagccaaaaaaactttaaggctaaaaacaaagcaaaaccagttaccactaatcttaagaagattcctcagcagcgtcatgaaagcaaaccagttaatgttgatgaagctacaagattaatggctctgttgtaatatactggtgatgcatctaatttctctcggaccaatgggtccgagcgtgacttgtta

SEQ ID NO: 277362 - DNA, 854 bp, Homo sapiens
  misc_feature (608)..(608): n is a, c, g, or t
  misc_feature (848)..(848): n is a, c, g, or t
ccccggaacttcctagacgccgtacgtgccagatggtgttacctggagcttaaaaagctgcacgcaagtgttaaacttctgtaggaggaatactgttggcgttcaaaagcattgctgtttcaaacagacaaattaagagggccgaagtccaggaatgtatttcacatagccagccaaaaaaactttaaggctaaaaacaaagcaaaaccagttaccactaatcttaagaaggttcttcatttttcctagaaaggtaaggatggtttcaagcatttgtctaaaaaaatataaaaaaaaaggaagaaaaataacctccctttcttgaaaacaaatgttgaaaagaaataaacattttaactacaaaaaaaaaaaaaaaaaaaaaaaaaaaaaaaaaaaaaaaaaggggggggcccccaaaaattccccccggggggccccattccccccccccgtttttgtgttccaaagggggccccccataagatgggaggcgcgtatatttaatagcccaagaaggcacgggcgccggcattttaaacaccggctggtcgctggggaaagaccggcgctacgcgctgggcgcactcttgtggaaagggagggaccgnccttccactctccgggggggggggggacccaatagtggggggccacaatctaccccctcagaggagggatattatagcggccctcggaggggcaacaactttacacttttccaggcggggctattcgtgcgcgttaacccccagccggcaaatgcccctggcgcgctgggaacaaattttggcccgaccgcgagattgcttttgggacctttttttttcgcggacttggttttataaagncgcata

SEQ ID NO: 277363 - DNA, 402 bp, Homo sapiens
ccccggaacttcctagacgccgtacgtgccagatggtgttacctggagcttaaaaagctgcacgcaagtgttaaacttctgaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcagaccagttaatgttgatgaagctacaagataatgctcttatacctaagagggccttggttgaactggcac

SEQ ID NO: 277364 - DNA, 2792 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaaggaaaaaaaggaagaatgttcaaggtgtctgtgcaagagaacagttagaccaggctggctagagcagtgtttatagggacgtaacaggagatatgtgtggcagatttagggtagattcagagtgccagtaatatgccaagccaaggcacgttgccccttatacattgggaaaactgttgaaggtttttaacattgggaaggtcgatcgcatagcttggtgccagatagccactgtgcagatggcttaagccaggagttggcagactttctgttaaaggtcggacactaaatattttggactttgtgggtcatagttatagcaggaaagcagccatatcagcatatgattgaatggacataactgtattccaattaaactttattttttaattaattaatttttttgagacagagtcttgctctgtcactcaggctggagtgcactggtgcaatcttggctcactgcaaccttcgccttccggattcaagcgattctccttcctcagtctcccgagtagctgggatcacaggcatgtgccaccacgcccagctaatttttgtatttgtagtagagacagggtttcaccatggtgaggctggtctctgccttcgcctcccaaagtgctgggattataggtgtgagccaccgcgcctgcacttggcctccaattaaactttactacaaggacaggtgcttggcctgatttggtccatgggcatagtttgacaaacagtggtttgaacaaatggacctagggacttcagcagtaatccagtcctgaactaagcaatactataccatttttttgtatagcttttatatttatacatgaagtgtaatatcacataacgttagctctgatctagtctgcctggctgtaagtcctggcatctcctggttattgacagtgtgacattgggcaaattaacttctctttgcgtcagttttttaattttaatctttaaaatggggataatagtacttcttacaaagggttgtaaggagtaaatgagttaaagcacataagtgtagtgcttgtacatataataaaagctcaatatgtgttaacttaatattttaaaaattattcctcatatacattattaaaggcagatctgagagatgttttaaggtagaatttactggcttaatgcatctctagctacggaggaaagacagtatccaacacttcaaggcaagggccgttcacatagaggtaatatggaagtcataaaagtaaattaagggagagagggaggtaggaaatggaggattaaggactgattttgatgggatgcacaggagagaaagtggggagagtaaaaaggaataaaaaagaagtcaagaaggaggcagaatcagtctctaaagtatgataggaaccagaatagcatagtagtatatagactaacagaaggatgggtggtgaggtactgctgagaataacagttattgtgttgatgatattagtgaattcaaccagcagatattaattggatgcctcctatgggcccattactggggatacagggaagaattagatacatactctgtactcaaagagcagaaaatctactaggagtgaaagacttggaaataatatatgcaccaactttaaaaataatcaagagtaagatagaattttttagatttaattggtacctttaaaaacttaaaattgacttacggttcataaatgtgggcaatttaattgaatttattttcttttctagacaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgtttgtggatattaaatcacttatcccctaaagcaatcagagccctttgtttttatggttgaagttttgt

SEQ ID NO: 277365 - DNA, 1057 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaagaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgtttgtggatattaaatcacttatcccctaaagcaatcagagccctttgtttttatggttgaagttttgt

SEQ ID NO: 277366 - DNA, 2299 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaaggaaaaaaaggaagaatgttcaaggtgtctgtgcaagagaacagttagaccaggctggctagagcagtgtttatagggacgtaacaggagatatgtgtggcagatttagggtagattcagagtgccagtaatatgccaagccaaggcacgttgccccttatacattgggaaaactgttgaaggtttttaacattgggaaggtcgatcgcatagcttggtgccagatagccactgtgcagatggcttaagccaggagttggcagactttctgttaaaggtcggacactaaatattttggactttgtgggtcatagttatagcaggaaagcagccatatcagcatatgattgaatggacataactgtattccaattaaactttattttttaattaattaatttttttgagacagagtcttgctctgtcactcaggctggagtgcactggtgcaatcttggctcactgcaaccttcgccttccggattcaagcgattctccttcctcagtctcccgagtagctgggatcacaggcatgtgccaccacgcccagctaatttttgtatttgtagtagagacagggtttcaccatggtgaggctggtctctgccttcgcctcccaaagtgctgggattataggtgtgagccaccgcgcctgcacttggcctccaattaaactttactacaaggacaggtgcttggcctgatttggtccatgggcatagtttgacaaacagtggtttgaacaaatggacctagggacttcagcagtaatccagtcctgaactaagcaatactataccatttttttgtatagcttttatatttatacatgaagtgtaatatcacataacgttagctctgatctagtctgcctggctgtaagtcctggcatctcctggttattgacagtgtgacattgggcaaattaacttctctttgcgtcagttttttaattttaatctttaaaatggggataatagtacttcttacaaagggttgtaaggagtaaatgagttaaagcacataagtgtagtgcttgtacatataataaaagctcaatatgtgttaacttaatattttaaaaattattcctcatatacattattaaaggcagatctgagagatgttttaaggtagaatttactggcttaatgcatctctagctacggaggaaagacagtatccaacacttcaaggcaagggccgttcacatagaggtaatatggaagtcataaaagtaaattaagggagagagggaggtaggaaatggaggattaaggactgattttgatgggatgcacaggagagaaagtggggagagtaaaaaggaataaaaaagaagtcaagaaggaggcagaatcagtctctaaagtatgataggaaccagaatagcatagtagtatatagactaacagaaggatgggtggtgaggtactgctgagaataacagttattgtgttgatgatattagtgaattcaaccagcagatattaattggatgcctcctatgggcccattactggggatacagggaagaattagatacatactctgtactcaaagagcagaaaatctactaggagtgaaagacttggaaataatatatgcaccaactttaaaaataatcaagagtaagatagaattttttagatttaattggtacctttaaaaacttaaaattgacttacggttcataaatgtgggcaatttaattgaatttattttcttttctagacaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttataca

SEQ ID NO: 277367 - DNA, 2310 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaaggaaaaaaaggaagaatgttcaaggtgtctgtgcaagagaacagttagaccaggctggctagagcagtgtttatagggacgtaacaggagatatgtgtggcagatttagggtagattcagagtgccagtaatatgccaagccaaggcacgttgccccttatacattgggaaaactgttgaaggtttttaacattgggaaggtcgatcgcatagcttggtgccagatagccactgtgcagatggcttaagccaggagttggcagactttctgttaaaggtcggacactaaatattttggactttgtgggtcatagttatagcaggaaagcagccatatcagcatatgattgaatggacataactgtattccaattaaactttattttttaattaattaatttttttgagacagagtcttgctctgtcactcaggctggagtgcactggtgcaatcttggctcactgcaaccttcgccttccggattcaagcgattctccttcctcagtctcccgagtagctgggatcacaggcatgtgccaccacgcccagctaatttttgtatttgtagtagagacagggtttcaccatggtgaggctggtctctgccttcgcctcccaaagtgctgggattataggtgtgagccaccgcgcctgcacttggcctccaattaaactttactacaaggacaggtgcttggcctgatttggtccatgggcatagtttgacaaacagtggtttgaacaaatggacctagggacttcagcagtaatccagtcctgaactaagcaatactataccatttttttgtatagcttttatatttatacatgaagtgtaatatcacataacgttagctctgatctagtctgcctggctgtaagtcctggcatctcctggttattgacagtgtgacattgggcaaattaacttctctttgcgtcagttttttaattttaatctttaaaatggggataatagtacttcttacaaagggttgtaaggagtaaatgagttaaagcacataagtgtagtgcttgtacatataataaaagctcaatatgtgttaacttaatattttaaaaattattcctcatatacattattaaaggcagatctgagagatgttttaaggtagaatttactggcttaatgcatctctagctacggaggaaagacagtatccaacacttcaaggcaagggccgttcacatagaggtaatatggaagtcataaaagtaaattaagggagagagggaggtaggaaatggaggattaaggactgattttgatgggatgcacaggagagaaagtggggagagtaaaaaggaataaaaaagaagtcaagaaggaggcagaatcagtctctaaagtatgataaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgtttgtggatattaaatcacttatcccctaaagcaatcagagccctttgtttttatggttgaagttttgt

SEQ ID NO: 277368 - DNA, 2675 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaaggaaaaaaaggaagaatgttcaaggtgtctgtgcaagagaacagttagaccaggctggctagagcagtgtttatagggacgtaacaggagatatgtgtggcagatttagggtagattcagagtgccagtaatatgccaagccaaggcacgttgccccttatacattgggaaaactgttgaaggtttttaacattgggaaggtcgatcgcatagcttggtgccagatagccactgtgcagatggcttaagccaggagttggcagactttctgttaaaggtcggacactaaatattttggactttgtgggtcatagttatagcaggaaagcagccatatcagcatatgattgaatggacataactgtattccaattaaactttattttttaattaattaatttttttgagacagagtcttgctctgtcactcaggctggagtgcactggtgcaatcttggctcactgcaaccttcgccttccggattcaagcgattctccttcctcagtctcccgagtagctgggatcacaggcatgtgccaccacgcccagctaatttttgtatttgtagtagagacagggtttcaccatggtgaggctggtctctgccttcgcctcccaaagtgctgggattataggtgtgagccaccgcgcctgcacttggcctccaattaaactttactacaaggacaggtgcttggcctgatttggtccatgggcatagtttgacaaacagtggtttgaacaaatggacctagggacttcagcagtaatccagtcctgaactaagcaatactataccatttttttgtatagcttttatatttatacatgaagtgtaatatcacataacgttagctctgatctagtctgcctggctgtaagtcctggcatctcctggttattgacagtgtgacattgggcaaattaacttctctttgcgtcagttttttaattttaatctttaaaatggggataatagtacttcttacaaagggttgtaaggagtaaatgagttaaagcacataagtgtagtgcttgtacatataataaaagctcaatatgtgttaacttaatattttaaaaattattcctcatatacattattaaaggcagatctgagagatgttttaaggtagaatttactggcttaatgcatctctagctacggaggaaagacagtatccaacacttcaaggcaagggccgttcacatagaggtaatatggaagtcataaaagtaaattaagggagagagggaggtaggaaatggaggattaaggactgattttgatgggatgcacaggagagaaagtggggagagtaaaaaggaataaaaaagaagtcaagaaggaggcagaatcagtctctaaagtatgataggaaccagaatagcatagtagtatatagactaacagaaggatgggtggtgaggtactgctgagaataacagttattgtgttgatgatattagtgaattcaaccagcagatattaattggatgcctcctatgggcccattactggggatacagggaagaattagatacatactctgtactcaaagagcagaaaatctactaggagtgaaagacttggaaataatatatgcaccaactttaaaaataatcaagagtaagatagaattttttagatttaattggtacctttaaaaacttaaaattgacttacggttcataaatgtgggcaatttaattgaatttattttcttttctagacaacagacaaattaagagggccgaagtccaggaatgtatttcacatagccagccaaaaaaactttaaggctaaaaacaaagcaaaaccagttaccactaatcttaagaagattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgtttgtggatattaaatcacttatcccctaaagcaatcagagccctttgtttttatggttgaagttttgt

SEQ ID NO: 277369 - DNA, 1469 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaaggaaaaaaaggaagaatgttcaaggtgtctgtgcaagagaacagttagaccaggctggctagagcagtgtttatagggacgtaacaggagatatgtgtggcagatttagggtagattcagagtgccagtaatatgccaagccaaggcacgttgccccttatacattgggaaaactgttgaaggtttttaacattgggaaggtcgatcgcatagcttggtgccagatagccactgtgcagatggcttaagccaggagttggcagactttctgttaaaggtcggacactaaatattttggactttgtgggtcatagttatagcaggaaagcagccatatcagcatatgattgaatggacataactgtattccaattaaactttattttttaattaattaatttttttgagacagagtcttgctctgtcactcaggctggagtgcactggtgcaatcttggctcactgcaaccttcgccttccggattcaagcgattctccttcctcagtctcccgagtagctgggatcacagaacagacaaattaagagggccgaagtccaggaatgtatttcacatagccagccaaaaaaactttaaggctaaaaacaaagcaaaaccagttaccactaatcttaagaagattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgtttgtggatattaaatcacttatcccctaaagcaatcagagccctttgtttttatggttgaagttttgt

SEQ ID NO: 277370 - DNA, 1677 bp, Homo sapiens
ctttaattaaaatctgacactgctgacctggagatagcgtcagattccacaggttgagagttgagtcctaagcctctccccaacttccagtgacaatcacaagtcccagatgttttacctgtgcttctcaccaaccagttataaataagtgttcccatgaccccctccttgggtttgattaatttgctagagcagctcacagaacccaggaaaatacttttaccagtttattataaaggatattacaaaggggacagatgcgtagccagatggaagaggtgcagagggcaaggtacatgggaaggggcatggagcttccctgctctctctgggcatgccactttctaggagcccccatgtgttcagctatccagaagctctttgaacccagttcttttgtagatttccggaggcttcattatgtaggcataattcattaaatcattggccattagtgatgggcttaacctttatccccactcctctggagcagaaagtcctaatcctctaaccctgtgtttttatctgactagccctcctcctgaagctatctagagactcccagctaccagccatcttattagcattcaaaagacactcttatccctcttaatacaatgatttaaaaagctgtatgacaggaaatgaggacaaagaccaaatatatatatatatcttattatgaatcacaatatcacagtcacatattttagccttctgaaccataagtgtgaggcatagccacataaatcccattttttaaaaaccaaaactttttgtctgtaatttcccaataagactataagaatttttgagtgaattatccctaatttgttggtaagagtttttagattttagatttaacaggttaaggttgaatatatcttatctttaatggttatgagatcatagattaatgctttttttctttttaaaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgtttgtggatattaaatcacttatcccctaaagcaatcagagccctttgtttttatggttgaagttttgt

SEQ ID NO: 277371 - DNA, 1966 bp, Homo sapiens
ctttaattaaaatctgacactgctgacctggagatagcgtcagattccacaggttgagagttgagtcctaagcctctccccaacttccagtgacaatcacaagtcccagatgttttacctgtgcttctcaccaaccagttataaataagtgttcccatgaccccctccttgggtttgattaatttgctagagcagctcacagaacccaggaaaatacttttaccagtttattataaaggatattacaaaggggacagatgcgtagccagatggaagaggtgcagagggcaaggtacatgggaaggggcatggagcttccctgctctctctgggcatgccactttctaggagcccccatgtgttcagctatccagaagctctttgaacccagttcttttgtagatttccggaggcttcattatgtaggcataattcattaaatcattggccattagtgatgggcttaacctttatccccactcctctggagcagaaagtcctaatcctctaaccctgtgtttttatctgactagccctcctcctgaagctatctagagactcccagctaccagccatcttattagcattcaaaagacactcttatccctcttaatacaatgatttaaaaagctgtatgacaggaaatgaggacaaagaccaaatatatatatatatcttattatgaatcacaatatcacagtcacatattttagccttctgaaccataagtgtgaggcatagccacataaatcccattttttaaaaaccaaaactttttgtctgtaatttcccaataagactataagaatttttgagtgaattatccctaatttgttggtaagagtttttagattttagatttaacaggttaaggttgaatatatcttatctttaatggttatgagatcatagattaatgctttttttctttttaaaagataaacattatgaatgaggaaaaagttaacagagtaaataaagcttttgtaaatgtacaaaaggaacttgcacatttcgcaaaaagcatttcacttgaacctctgcagaaagaactggtaagcagaaatcatttgcttttttttatggctaacaaattgaggctaataaattaaactcccaagttttcaaagcctgtaagttgagtgtaatttttagtacttggctctctagtactaggctctatagtataaatagcatattcagactctaaaacattgtcagaatatacagattgttctacttccaaagatatgactagaaaaattaaattgaataacagcttatataagtcatttgtctgctattgttgtctgtgtttttaaatataatactttctcctttcagattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgtttgtggatattaaatcacttatcccctaaagcaatcagagccctttgtttttatggttgaagttttgt

SEQ ID NO: 277372 - DNA, 587 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaaggaaaaaaaggaagaatgttcaagaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttataca

SEQ ID NO: 277373 - DNA, 2106 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaaggaaaaaaaggaagaatgttcaaggtgtctgtgcaagagaacagttagaccaggctggctagagcagtgtttatagggacgtaacaggagatatgtgtggcagatttagggtagattcagagtgccagtaatatgccaagccaaggcacgttgccccttatacattgggaaaactgttgaaggtttttaacattgggaaggtcgatcgcatagcttggtgccagatagccactgtgcagatggcttaagccaggagttggcagactttctgttaaaggtcggacactaaatattttggactttgtgggtcatagttatagcaggaaagcagccatatcagcatatgattgaatggacataactgtattccaattaaactttattttttaattaattaatttttttgagacagagtcttgctctgtcactcaggctggagtgcactggtgcaatcttggctcactgcaaccttcgccttccggattcaagcgattctccttcctcagtctcccgagtagctgggatcacaggcatgtgccaccacgcccagctaatttttgtatttgtagtagagacagggtttcaccatggtgaggctggtctctgccttcgcctcccaaagtgctgggattataggtgtgagccaccgcgcctgcacttggcctccaattaaactttactacaaggacaggtgcttggcctgatttggtccatgggcatagtttgacaaacagtggtttgaacaaatggacctagggacttcagcagtaatccagtcctgaactaagcaatactataccatttttttgtatagcttttatatttatacatgaagtgtaatatcacataacgttagctctgatctagtctgcctggctgtaagtcctggcatctcctggttattgacagtgtgacattgggcaaattaacttctctttgcgtcagttttttaattttaatctttaaaatggggataatagtacttcttacaaagggttgtaaggagtaaatgagttaaagcacataagtgtagtgcttgtacatataataaaagctcaatatgtgttaacttaatattttaaaaattattcctcatatacattattaaaggcagatctgagagatgttttaaggtagaatttactggcttaatgcatctctagctacggaggaaagacagtatccaacacttcaaggcaagggccgttcacatagaggtaatatggaagtcataaaagtaaattaagggagagagggaggtaggaaatggaggattaaggactgattttgatgggatgcacaggagagaaagtggggagagtaaaaaggaataaaaaagaagtcaagaaggaggcagaatcagtctctaaagtatgataaggaaaaagttaacagagtaaataaagcttttgtaaatgtacaaaaggaacttgcacatttcgcaaaaagcatttcacttgaacctctgcagaaagaactggtaagcagaaatcatttgcttttttttatggctaacaaattgaggctaataaattaaactcccaagttttcaaagcctgtaagttgagtgtaatttttagtacttggctctctagtactaggctctatagtataaatagcatattcagactctaaaacattgtcagaatatacagattgttctacttccaaagatatgactagaaaaattaaattgaataacagcttatataagtcatttgtctgctattgttgtctgtgtttttaaatataatactttctcctttcagattcctcagcagcgtcatgaaagcaaaccagttaatgttgatgaagctacaagattaatggctctgttgtaatatactggtgatgcatctaattctccacaaagaccaataaattgaatgttttataca

SEQ ID NO: 277374 - DNA, 2628 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaaggaaaaaaaggaagaatgttcaaggtgtctgtgcaagagaacagttagaccaggctggctagagcagtgtttatagggacgtaacaggagatatgtgtggcagatttagggtagattcagagtgccagtaatatgccaagccaaggcacgttgccccttatacattgggaaaactgttgaaggtttttaacattgggaaggtcgatcgcatagcttggtgccagatagccactgtgcagatggcttaagccaggagttggcagactttctgttaaaggtcggacactaaatattttggactttgtgggtcatagttatagcaggaaagcagccatatcagcatatgattgaatggacataactgtattccaattaaactttattttttaattaattaatttttttgagacagagtcttgctctgtcactcaggctggagtgcactggtgcaatcttggctcactgcaaccttcgccttccggattcaagcgattctccttcctcagtctcccgagtagctgggatcacaggcatgtgccaccacgcccagctaatttttgtatttgtagtagagacagggtttcaccatggtgaggctggtctctgccttcgcctcccaaagtgctgggattataggtgtgagccaccgcgcctgcacttggcctccaattaaactttactacaaggacaggtgcttggcctgatttggtccatgggcatagtttgacaaacagtggtttgaacaaatggacctagggacttcagcagtaatccagtcctgaactaagcaatactataccatttttttgtatagcttttatatttatacatgaagtgtaatatcacataacgttagctctgatctagtctgcctggctgtaagtcctggcatctcctggttattgacagtgtgacattgggcaaattaacttctctttgcgtcagttttttaattttaatctttaaaatggggataatagtacttcttacaaagggttgtaaggagtaaatgagttaaagcacataagtgtagtgcttgtacatataataaaagctcaatatgtgttaacttaatattttaaaaattattcctcatatacattattaaaggcagatctgagagatgttttaaggtagaatttactggcttaatgcatctctagctacggaggaaagacagtatccaacacttcaaggcaagggccgttcacatagaggtaatatggaagtcataaaagtaaattaagggagagagggaggtaggaaatggaggattaaggactgattttgatgggatgcacaggagagaaagtggggagagtaaaaaggaataaaaaagaagtcaagaaggaggcagaatcagtctctaaagtatgataggaaccagaatagcatagtagtatatagactaacagaaggatgggtggtgaggtactgctgagaataacagttattgtgttgatgatattagtgaattcaaccagcagatattaattggatgcctcctatgggcccattactggggatacagggaagaattagatacatactctgtactcaaagagcagaaaatctactaggagtgaaagacttggaaataatatatgcaccaactttaaaaataatcaagagtaagatagaattttttagatttaattggtacctttaaaaacttaaaattgacttacggttcataaatgtgggcaatttaattgaatttattttcttttctagacaacagacaaattaagagggccgaagtccaggaatgtatttcacatagccagccaaaaaaactttaaggctaaaaacaaagcaaaaccagttaccactaatcttaagaaggtgagtattagttaagcactctgactttattgtttacaagcaaagtgtcattgtaagctactgaacagctgtatactattactttttaaaaaggttcttcatttttcctagaaaggtaaggatggtttcaagcatttgtctaaaaaaatataaaaaaaaaggaagaaaaataacctccctttcttgaaaacaaatgttgaaaagaaataaacattttaactacaaatgtgtgaagcttcaatttaatagttttactgaaccatagaactcatttaaaaaccatagtatgggaaacagttcttatctctaaactcaaatgtaagaatgtattaatagaggcaagacatgggatgtcagtgagcacccattctttttctcctcagtaattcttgtatctttgaagacatctgcaattcaaacaaaaacctgtaaaatgaagataaaaaatatttattgaaatgcacaatttgaaaggggtttcttttctttgtttatatttcaaaatacctgagaaatttctacaagatttaagaaaaatttttaagaaaatgttttcaagtttcagtagtagatgg

SEQ ID NO: 277375 - DNA, 1600 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaaggaaaaaaaggaagaatgttcaaggtgtctgtgcaagagaacagttagaccaggctggctagagcagtgtttatagggacgtaacaggagatatgtgtggcagatttagggtagattcagagtgccagtaatatgccaagccaaggcacgttgccccttatacattgggaaaactgttgaaggtttttaacattgggaaggtcgatcgcatagcttggtgccagatagccactgtgcagatggcttaagccaggagttggcagactttctgttaaaggtcggacactaaatattttggactttgtgggtcatagttatagcaggaaagcagccatatcagcatatgattgaatggacataactgtattccaattaaactttattttttaattaattaatttttttgagacagagtcttgctctgtcactcaggctggagtgcactggtgcaatcttggctcactgcaaccttcgccttccggattcaagcgattctccttcctcagtctcccgagtagctgggatcacaggcatgtgccaccacgcccagctaatttttgtatttgtagtagagacagggtttcaccatggtgaggctggtctctgccttcgcctcccaaagtgctgggattataggtgtgagccaccgcgcctgcacttggcctccaattaaactttactacaaggacaggtgcttggcctgatttggtccatgggcatagtttgacaaacagtggtttgaacaaatggacctagggacttcagcagtaatccagtcctgaactaagcaatactataccatttttttgtatagcttttatatttatacatgaagtgtaatatcacataacgttagctctgatctagtctgcctggctgtaagtcctggcatctcctggttattgacagtgtgacattgggcaaattaacttctctttgcgtcagttttttaattttaatctttaaaatggggataatagtacttcttacaaagggttgtaaggagtaaatgagttaaagcacataagtgtagtgcttgtacatataataaaagctcaatatgtgttaacttaatattttaaaaattattcctcatatacattattaaaggcagatctgagagatgttttaaggtagaatttactggcttaatgcatctctagctacggaggaaagacagtatccaacacttcaaggcaagggccgttcacatagaggtaatatggaagtcataaaagtaaattaagggagagagggaggtaggaaatggagattattttatttggacaggaggtactagaacttttatatatgccaccaggtaggatctaagagagagatctatgggtaggctgcataaggtgcaaaggaggtaagggttttgaaggagaa

SEQ ID NO: 277376 - DNA, 929 bp, Homo sapiens
ccccggaacttcctagacgccgtacgtgccagatggtgttacctggagcttaaaaagctgcacgcaagtgttaaacttctgaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgtttgtggatattaaatcacttatcccctaaagcaatcagagccctttgtttttatggttgaagttttgt

SEQ ID NO: 277377 - DNA, 929 bp, Homo sapiens
ccccggaacttcctagacgccgtacgtgccagatggtgttacctggagcttaaaaagctgcacgcaagtgttaaacttctgtaggaggaatactgttggcgttcaaaagcattgctgtttcagttaagtagttccttaattacttacaatgtagtaaggctacattgaaggaagatataaatttcagtcaagactacgactgagcaaagaacagacaaattaagagggccgaagtccaggaatgtatttcacatagccagccaaaaaaactttaaggctaaaaacaaagcaaaaccagttaccactaatcttaagaagataaacattatgaatgaggaaaaagttaacagagtaaataaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgtaatatactggtgatgcatctaattctccacaaagaccaataaattgaatgttttatacaaagaacaaatgcgccccccgccccaacccgacaccccgagccccccgcaccccgacaccccacacgaccgacgcaaccaagcaacaaagaaaggacaactaacacgcaacaaaggcggcgcgcgccaccgcaagtcgccccctgaggcgaccgcacacaaacgcgccgccatgagcgcacaagaagccgcagatcaaccggcgactaatcatacgaccggccgccgccgcccataacagacacgcccgacacaaacgcaccgttctcgaacgaaggccacctcgtggggggagacaacgacacacaccacgacacgagccgagcgagcaataacacgagtcagggtgaaccacaccgctcgtcaa

SEQ ID NO: 277378 - DNA, 765 bp, Homo sapiens
ccccggaacttcctagacgccgtacgtgccagatggtgttacctggagcttaaaaagctgcacgcaagtgttaaacttctgaacagacaaattaagagggccgaagtccaggaatgtatttcacatagccagccaaaaaaactttaaggctaaaaacaaagcaaaaccagttaccactaatcttaagaaggtgagtattagttaagcactctgactttattgtttacaagcaaagtgtcattgtaagctactgaacagctgtatactattactttttaaaaaggttcttcatttttcctagaaaggtaaggatggtttcaagcatttgtctaaaaaaatataaaaaaaaaggaagaaaaataacctccctttcttgaaaacaaatgttgaaaagaaataaacattttaactacaaatgtgtgaagcttcaatttaatagttttactgaaccatagaactcatttaaaaaccatagtatgggaaacagttcttatctctaaactcaaatgtaagaatgtattaatagaggcaagacatgggatgtcagtgagcacccattctttttctcctcagtaattcttgtatctttgaagacatctgcaattcaaacaaaaacctgtaaaatgaagataaaaaatatttattgaaatgcacaatttgaaaggggtttcttttctttgtttatatttcaaaatacctgagaaatttctacaagatttaagaaaaatttttaagaaaatgttttcaagtttcagtagtagatgg

SEQ ID NO: 277379 - DNA, 2193 bp, Homo sapiens
tggggccgaggcggcgcgcggcgctgacagctgagtcggctcgcggcctcccggccccctcggcgcccggcccgaccctggcctggcctgccctgccccggagccatgagccccgggctgctgctgctcggcagcgccgtcctgctcgccttcggcctctgctgcaccttcgtgcaccgcgctcgcagccgctacgagcacatccccgggccgccgcggcccagtttccttctaggacacctcccctgcttttggaaaaaggatgaggttggtggccgtgtgctccaagatgtgtttttggattgggctaagaagtatggacctgttgtgcgggtcaacgtcttccacaaaacctcagtcatcgtcacgagtcctgagtcggttaagaagttcctgatgtcaaccaagtacaacaaggactccaagatgtaccgtgcgctccagactgtgtttggtgagagactcttcggccaaggcttggtgtccgaatgcaactatgagcgctggcacaagcagcggagagtcatagacctggccttcagccggagctccttggttagcttaatggaaacattcaacgagaaggctgagcagctggtggagattctagaagccaaggcagatgggcagaccccagtgtccatgcaggacatgctgacctacaccgccatggacatcctggccaaggcagcttttgggatggagaccagtatgctgctgggtgcccagaagcctctgtcccaggcagtgaaacttatgttggagggaatcactgcgtcccgcaacactctggcaaagttcctgccagggaagaggaagcagctccgggaggtccgggagagcattcgcttcctgcgccaggtgggcagggactgggtccagcgccgccgggaagccctgaagaggggcgaggaggttcctgccgacatcctcacacagattctgaaagctgaagagggagcccaggacgacgagggtctgctggacaacttcgtcaccttcttcattgctggtcacgagacctctgccaaccacttggcgttcacagtgatggagctgtctcgccagccagagatcgtggcaaggctgcaggccgaggtggatgaggtcattggttctaagaggtacctggatttcgaggacctggggagactgcagtacctgtcccaggtcctcaaagagtcgctgaggctgtacccaccagcatggggcacctttcgcctgctggaagaggagaccttgattgatggggtcagagtccccggcaacaccccgctcttgttcagcacctatgtcatggggcggatggacacatactttgaggacccgctgactttcaaccccgatcgcttcggccctggagcacccaagccacggttcacctacttccccttctccctgggccaccgctcctgcatcgggcagcagtttgctcagatggaggtgaaggtggtcatggcaaagctgctgcagaggctggagttccggctggtgcccgggcagcgcttcgggctgcaggagcaggccacactcaagccactggaccccgtgctgtgcaccctgcggccccgcggctggcagcccgcacccccaccacccccctgctgagggggcctccaggcaggacgagactcctcgggcaagggccgtgcccgcccacctctgctgcccacggccacccacccttctcccctgccccgtcccctgggccacccttcacgctggcttccagcgggccctctgccgaccgcctgcttcacacccctcagcgctccctgtcgcctgcggactccatggcccttcctggactggcccttgcccaactcccagccaccaccactgtccctaccactgagcccttgcacaggccacttgctcagacgagacaccctaactcttgctcactccctaaagccctcttcaggggtcacctcctccaagaagccctccttgccaccccccgccggcaggggcccctcctctgtgctccctcggtcacctgtgctacctctaacaccacactgaccacactgtatcgtgagtgtccgttgacgtgaccaattgccctgccaggctgtcagcgcctcaagggtagggtctgcgtgtgatttgtctctgagccccctgtgcccacccagggcccggcacagagtcgatgctcaataaatgtgtgttgactgcatgaatgacctg

SEQ ID NO: 277380 - DNA, 1125 bp, Homo sapiens
cactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaaggtgaggcggactgggggtaagggcaggggc

SEQ ID NO: 277381 - DNA, 641 bp, Homo sapiens
aggatccaacagaaagccctgctgtctggggtgggcaggacctctgaaaggttttggaacccagtatctttgtccttatagcctgattggtgaaaggggctgagcggctcctgctgcttcctcttgatggctgggacttctgtcatctcagctggaatttaatcacaacccattacactgaaataatgccttgggtgcactgctgcccccattctagacaagagcagattaactttggtgaatgccttgcccaaggtcacaggtagtgacaaagctgacactcagattcaggcttattggatcccaaagccatccttccacctgggctccctcattggccattcagaaacaacccccactctactgagaaatcgaaggcagcaccgctaaaccctctggcaaactacaggggcgatttggtcagtgctcctcccaccacacccaggatgactgttccccttccctcctaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagcgcgaaggggatcctctataacagcgc

SEQ ID NO: 277382 - DNA, 4279 bp, Homo sapiens
cactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctgagctggcttctgtggtgtgtgctcgtttggggggtggggtggaaatactgccaaggctggggggggccacctctccatctggtcagtttgtggggtgggtactctgccagcagatgggaggatatagggaaacagcacacaagtctaaggggggtgcccaagggggttattttcatcatatatttattacataaatatatagtaaaatagacgagcaacaattaccataaaaatatctttctttaaaatcctgacccaaaacacaacggggtgaaaaatcgcacataacagacatactgattgtcaacgtggggcaggagtaggagcccctcaagtcacccctgccggtcccacccctccctggggaagagacctacctccttccctgtttctggccacaacccccctccccccagcccagcaccagcttctcatacattcagtagcgcctctgggcagtgtccccctcccccccgcccaggagttcccagggcaggagttactgtcctccttatggacggtctctctctcacaacgccctgccctctcccagccctgcagacccgccaccaggagaaggggtaggggctcctcccccaccctccccaagtctgagcagggaggaggctggatgaggtatgtgtgttatgagtgatgggaggggcaatactgagatggagaggcgggtggtgggggcggggtagtggtcatggctctggcaaccccttgtcctggcctggccccctcgtcctattcccagcaacccgtcctcccaccgatactgcacctgctgctccaccctgcctgccctagtgccccgggccaatactgggggaggcatgctgagcacccacatcaaggccatccccctcattagcaccaatggcccccaggagagggccctgtcccccacttccacagcagggactgggacagctgccgctctagagcaggtgcgtggcactcctgagtcgccctggctcctcccctaccatgtgtactcactcacacattcacgcagaggaacgcacacatacaccccacatcaccgagggggaagggaggggtccggggaggatgggatcacagctcatatgattggggagggtgggggagtcccaagtgcctataagaggctaaggctcttcaaggccttttctctgccgtgtccatggctgagaatggggatggaggggttggggtggggatggagggatggggaagacagcagacaggtcaggaattccactgggcccccaggcgtggtaggaaggtacaagagggcctacccatgggactggagtaatacaggattcagtactccaggagagagagagaggatagagacaaagacagcgcgggcagcccgaggccccagcagggtgggacaggcacatgcacaggtgacagcgggtgctcctccaggccctccacccctgttggaacacctgaacgattggggaaggacagtgccctgacggcacctcctaatgaaaacggacgagctga

SEQ ID NO: 277383 - DNA, 3481 bp, Homo sapiens
cactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctgagctggcttctgtggtgtgtgctcgtttggggggtggggtggaaatactgccaaggctggggggggccacctctccatctggtcagtttgtggggtgggtactctgccagcagatgggaggatatagggaaacagcacacaagtctaaggggggtgcccaagggggttattttcatcatatatttattacataaatatatagtaaaatagacgagcaacaattaccataaaaatatctttctttaaaatcctgacccaaaacacaacggggtgaaaaatcgcacataacagacatactgattgtcaacgtggggcaggagtaggagcccctcaagtcacccctgccggtcccacccctccctggggaagagacctacctccttccctgtttctggccacaacccccctccccccagcccagcaccagcttctcatacattcagtagcgcctctgggcagtgtccccctcccccccgcccaggagttcccagggcaggagttactgtcctccttatggacggtctctctctcacaacgccctgccctctcccagccctgcagacccgccaccaggagaaaaggccttgaagagccttagcctcttataggcacttgggactcccccaccctccccaatcataggagcccctaccccttctcctgcagacccgccgccaggagcctcggccgataaccccggcctctacctgg

SEQ ID NO: 277384 - DNA, 4247 bp, Homo sapiens
cactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctgagctggcttctgtggtgtgtgctcgtttggggggtggggtggaaatactgccaaggctggggggggccacctctccatctggtcagtttgtggggtgggtactctgccagcagatgggaggatatagggaaacagcacacaagtctaaggggggtgcccaagggggttattttcatcatatatttattacataaatatatagtaaaatagacgagcaacaattaccataaaaatatctttctttaaaatcctgacccaaaacacaacggggtgaaaaatcgcacataacagacatactgattgtcaacgtggggcaggagtaggagcccctcaagtcacccctgccggtcccacccctccctggggaagagacctacctccttccctgtttctggccacaacccccctccccccagcccagcaccagcttctcatacattcagtagcgcctctgggcagtgtccccctcccccccgcccaggagttcccagggcaggagttactgtcctccttatggacggtctctctctcacaacgccctgccctctcccagccctgcagacccgccaccaggagaaggggtaggggctcctcccccaccctccccaagtctgagcagggaggaggctggatgaggtatgtgtgttatgagtgatgggaggggcaatactgagatggagaggcgggtggtgggggcggggtagtggtcatggctctggcaaccccttgtcctggcctggccccctcgtcctattcccagcaacccgtcctcccaccgatactgcacctgctgctccaccctgcctgccctagtgccccgggccaatactgggggaggcatgctgagcacccacatcaaggccatccccctcattagcaccaatggcccccaggagagggccctgtcccccacttccacagcagggactgggacagctgccgctctagagcaggtgcgtggcactcctgagtcgccctggctcctcccctaccatgtgtactcactcacacattcacgcagaggaacgcacacatacaccccacatcaccgagggggaagggaggggtccggggaggatgggatcacagctcatatgattggggagggtgggggagtcccaagtgcctataagaggctaaggctcttcaaggccttttctctgccgtgtccatggctgagaatggggatggaggggttggggtggggatggagggatggggaagacagcagacaggtcaggaattccactgggcccccaggcgtggtaggaaggtacaagagggcctacccatgggactggagtaatacaggattcagtactccaggagagagagagaggatagagacaaagacagcgcgggcagcccgaggccccagcagggtgggacaggcacatgcacaggtgacagcgggtgctcctccaggccctccacccctgttggaacacctgaacgattggggaaggacagtgccctgacgggcagcatagcattgccttcccatgtccgtgtgtgcatgtccgtgtgtgtgtgtgtgtgtgtgtgttacttttacaatcaggaaaacatatttaataacatatagtcaagaaaacagacttaaaaat

SEQ ID NO: 277385 - DNA, 3522 bp, Homo sapiens
cactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctgagctggcttctgtggtgtgtgctcgtttggggggtggggtggaaatactgccaaggctggggggggccacctctccatctggtcagtttgtggggtgggtactctgccagcagatgggaggatatagggaaacagcacacaagtctaaggggggtgcccaagggggttattttcatcatatatttattacataaatatatagtaaaatagacgagcaacaattaccataaaaatatctttctttaaaatcctgacccaaaacacaacggggtgaaaaatcgcacataacagacatactgattgtcaacgtggggcaggagtaggagcccctcaagtcacccctgccggtcccacccctccctggggaagagacctacctccttccctgtttctggccacaacccccctccccccagcccagcaccagcttctcatacattcagtagcgcctctgggcagtgtccccctcccccccgcccaggagttcccagggcaggagttactgtcctccttatggacggtctctctctcacaacgccctgccctctcccagccctgcagacccgccaccaggagaaggggtaggggctcctcccccaccctccccaagtctgagcagggaggaggctggatgaggtatgtgtgttatgagtgatgggaggggcaatactgagatggagaggcgggtggtgggggcggggtagtggtcatggctctggcaaccccttgtcctggcctggccccctcgtcctattcccagcaacccgtcctcccaccgatactgcacctgctgctccaccctgcctgccctagtgccccgggccaatactgggggaggcatgctgagcacccacatcaaggccatccccctcattagcaccaatggcccccaggagagggccctgtcccccacttccacagcagggactgggacagctgccgctctagagcaggtgcgtggcactcctgagtcgccctggctcctcccctaccatgtgtactcactcacacattcacgcagaggaacgcacacatacaccccacatcaccgagggggaagggaggggtccggggaggatgggatcacagctcatatgattggggagggtgggggagtcccaagtgcctataagaggctaaggctcttcaaggccttttctctgccgtgtccatggctgagaatggggatggaggggttggggtggggatggagggatggggaagacagcagacaggtcaggaattccactgggcccccaggcgtggtaggaaggtacaagagggcctacccatgggactggagtaatacaggattcagtactccaggagagagagagaggatagagacaaagacagcgcgggcagcccgaggccccagcagggtgggacaggcacatgcacaggtgacagcgggtgctcctccaggccctccacccctgttggaacacctgaacgattggggaaggacagtgccctgacgggcagcatagcattgccttcccatgtccgtgtgtgcatgtccgtgtgtgtgtgtgtgtgtgtgtgttacttttacaatcaggaaaacatatttaataacatatagtcaagaaaacagacttaaaaat

SEQ ID NO: 277386 - DNA, 2612 bp, Homo sapiens
cactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatga

SEQ ID NO: 277387 - DNA, 1847 bp, Homo sapiens
tgcaggcctcgcccccagtagagcctcaaagtcaaagctcagcatgttcagggttgtaggtctagaggaaagcaccagtagggtcttcatcctcagcaaccatgaggtccacacctgcctccctcccccatcaccgaacttcccctcctcccctatttaaaccactctgtctcccccacaaccctcccctggccctctgatttgttctgttcctgtctcaaatccaatagttcacagctgagctggcttctgtggtgtgtgctcgtttggggggtggggtggaaatactgccaaggctggggggggccacctctccatctggtcagtttgtggggtgggtactctgccagcagatgggaggatatagggaaacagcacacaagtctaaggggggtgcccaagggggttattttcatcatatatttattacataaatatatagtaaaatagacgagcaacaattaccataaaaatatctttctttaaaatcctgacccaaaacacaacggggtgaaaaatcgcacataacagacatactgattgtcaacgtggggcaggagtaggagcccctcaagtcacccctgccggtcccacccctccctggggaagagacctacctccttccctgtttctggccacaacccccctccccccagcccagcaccagcttctcatacattcagtagcgcctctgggcagtgtccccctcccccccgcccaggagttcccagggcaggagttactgtcctccttatggacggtctctctctcacaacgccctgccctctcccagccctgcagacccgccaccaggagaaggggtaggggctcctcccccaccctccccaagtctgagcagggaggaggctggatgaggtatgtgtgttatgagtgatgggaggggcaatactgagatggagaggcgggtggtgggggcggggtagtggtcatggctctggcaaccccttgtcctggcctggccccctcgtcctattcccagcaacccgtcctcccaccgatactgcacctgctgctccaccctgcctgccctagtgccccgggccaatactgggggaggcatgctgagcacccacatcaaggccatccccctcattagcaccaatggcccccaggagagggccctgtcccccacttccacagcagggactgggacagctgccgctctagagcaggtgcgtggcactcctgagtcgccctggctcctcccctaccatgtgtactcactcacacattcacgcagaggaacgcacacatacaccccacatcaccgagggggaagggaggggtccggggaggatgggatcacagctcatatgattggggagggtgggggagtcccaagtgcctataagaggctaaggctcttcaaggccttttctctgccgtgtccatggctgagaatggggatggaggggttggggtggggatggagggatggggaagacagcagacaggtcaggaattccactgggcccccaggcgtggtaggaaggtacaagagggcctacccatgggactggagtaatacaggattcagtactccaggagagagagagaggatagagacaaagacagcgcgggcagcccgaggccccagcagggtgggacaggcacatgcacaggtgacagcgggtgctcctccaggccctccacccctgttggaacacctgaacgattggggaaggacagtgccctgacgggcagcatagcattgccttcccatgtccgtgtgtgcatgtccgtgtgtgtgtgtgtgtgtgtgtgttacttttacaatcaggaaaacatatttaataacatatagtcaagaaaacagacttaaaaat

SEQ ID NO: 277388 - DNA, 2352 bp, Homo sapiens
aggatccaacagaaagccctgctgtctggggtgggcaggacctctgaaaggttttggaacccagtatctttgtccttatagcctgattggtgaaaggggctgagcggctcctgctgcttcctcttgatggctgggacttctgtcatctcagctggaatttaatcacaacccattacactgaaataatgccttgggtgcactgctgcccccattctagacaagagcagattaactttggtgaatgccttgcccaaggtcacaggtagtgacaaagctgacactcagattcaggcttattggatcccaaagccatccttccacctgggctccctcattggccattcagaaacaacccccactctactgagaaatcgaaggcagcaccgctaaaccctctggcaaactacaggggcgatttggtcagtgctcctcccaccacacccaggatgactgttccccttccctcctaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcaggtaggtcaggctctcgcctgaccgggggaggaggcagacgcagttcaattcaacacaccttttatggagtacctactctatgccaggccctgcaccgggcactggggatacagacatgattcagacacagtctagcttgggaaacagactcatgcccgactaattataaaacagtgagataagtgtcacagtagaagcatgaaccaaggaagcacagacaactatttctgcctgggggagctggggaaggaggtgacacttgagttggggcctcaaaggacaagtaagatgttgccaggcagagaaagggggaagggcatcccaggcagagggaactacacagcaaaaagcaagggagtctggccatgtttggcctgctgaggaagggaaggtggtcttacgggatgggaggtgaccagccctgctgagcccacgctcccagctttcaggcacctcctgctcttggggcagaggcctgggagaaggtatggcactccttctccttccccatcggccttctggggggcttcagggagaggctgcattgcctgccaggtcctcgcagacctccggttcctcctcagaggagctcggggagtccgcctcactgctgtcgtcttccccacagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctgagctggcttctgtggtgtgtgctcgtttggggggtggggtggaaatactgccaaggctggggggggccacctctccatctggtcagtttgtggggtgggtactctgccagcagatgggaggatatagggaaacagcacacaagtctaaggggggtgcccaagggggttattttcatcatatatttattacataaatatatagtaaaatagacgagcaacaattaccataaaaatatctttctttaaaatcctgacccaaaacacaacggggtgttctctccaggctcctccccacactccgcacaccctctggccgcctgaggctttagacttcctgatcctcaaagacctcgaggaagagtggggggaagagttcggtggggcactcgactttcatgtggaggaagcggctggcgtggcaggccccgatcatgcggaggtcagtcaccttcatcagcagcttgggccagaagtgcggaatgttgtgtttgcggtggttgacgtagtgctcgaacgccagcaggtacgcctcctgactcttctcgatcttgtcc

SEQ ID NO: 277389 - DNA, 4377 bp, Homo sapiens
cactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctgagctggcttctgtggtgtgtgctcgtttggggggtggggtggaaatactgccaaggctggggggggccacctctccatctggtcagtttgtggggtgggtactctgccagcagatgggaggatatagggaaacagcacacaagtctaaggggggtgcccaagggggttattttcatcatatatttattacataaatatatagtaaaatagacgagcaacaattaccataaaaatatctttctttaaaatcctgacccaaaacacaacggggtgaaaaatcgcacataacagacatactgattgtcaacgtggggcaggagtaggagcccctcaagtcacccctgccggtcccacccctccctggggaagagacctacctccttccctgtttctggccacaacccccctccccccagcccagcaccagcttctcatacattcagtagcgcctctgggcagtgtccccctcccccccgcccaggagttcccagggcaggagttactgtcctccttatggacggtctctctctcacaacgccctgccctctcccagccctgcagacccgccaccaggagaaggggtaggggctcctcccccaccctccccaagtctgagcagggaggaggctggatgaggtatgtgtgttatgagtgatgggaggggcaatactgagatggagaggcgggtggtgggggcggggtagtggtcatggctctggcaaccccttgtcctggcctggccccctcgtcctattcccagcaacccgtcctcccaccgatactgcacctgctgctccaccctgcctgccctagtgccccgggccaatactgggggaggcatgctgagcacccacatcaaggccatccccctcattagcaccaatggcccccaggagagggccctgtcccccacttccacagcagggactgggacagctgccgctctagagcaggtgcgtggcactcctgagtcgccctggctcctcccctaccatgtgtactcactcacacattcacgcagaggaacgcacacatacaccccacatcaccgagggggaagggaggggtccggggaggatgggatcacagctcatatgattggggagggtgggggagtcccaagtgcctataagaggctaaggctcttcaaggccttttctctgccgtgtccatggctgagaatggggatggaggggttggggtggggatggagggatggggaagacagcagacaggtcaggaattccactgggcccccaggcgtggtaggaaggtacaagagggcctacccatgggactggagtaatacaggattcagtactccaggagagagagagaggatagagacaaagacagcgcgggcagcccgaggccccagcagggtgggacaggcacatgcacaggtgacagcgggtgctcctccaggccctccacccctgttggaacacctgaacgattggggaaggacagtgccctgacgggcagcatagcattgccttcccatgtccgtgtgtgcatgtccgtgtgtgtgtgtgtgtgtgtgtgttacttttacaatcaggaaaacatatttaataacatatagtcaagaaaacagacttaaaaat

SEQ ID NO: 277390 - DNA, 5005 bp, Homo sapiens
cactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcaggtaggtcaggctctcgcctgaccgggggaggaggcagacgcagttcaattcaacacaccttttatggagtacctactctatgccaggccctgcaccgggcactggggatacagacatgattcagacacagtctagcttgggaaacagactcatgcccgactaattataaaacagtgagataagtgtcacagtagaagcatgaaccaaggaagcacagacaactatttctgcctgggggagctggggaaggaggtgacacttgagttggggcctcaaaggacaagtaagatgttgccaggcagagaaagggggaagggcatcccaggcagagggaactacacagcaaaaagcaagggagtctggccatgtttggcctgctgaggaagggaaggtggtcttacgggatgggaggtgaccagccctgctgagcccacgctcccagctttcaggcacctcctgctcttggggcagaggcctgggagaaggtatggcactccttctccttccccatcggccttctggggggcttcagggagaggctgcattgcctgccaggtcctcgcagacctccggttcctcctcagaggagctcggggagtccgcctcactgctgtcgtcttccccacagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctgagctggcttctgtggtgtgtgctcgtttggggggtggggtggaaatactgccaaggctggggggggccacctctccatctggtcagtttgtggggtgggtactctgccagcagatgggaggatatagggaaacagcacacaagtctaaggggggtgcccaagggggttattttcatcatatatttattacataaatatatagtaaaatagacgagcaacaattaccataaaaatatctttctttaaaatcctgacccaaaacacaacggggtgaaaaatcgcacataacagacatactgattgtcaacgtggggcaggagtaggagcccctcaagtcacccctgccggtcccacccctccctggggaagagacctacctccttccctgtttctggccacaacccccctccccccagcccagcaccagcttctcatacattcagtagcgcctctgggcagtgtccccctcccccccgcccaggagttcccagggcaggagttactgtcctccttatggacggtctctctctcacaacgccctgccctctcccagccctgcagacccgccaccaggagaaggggtaggggctcctcccccaccctccccaagtctgagcagggaggaggctggatgaggtatgtgtgttatgagtgatgggaggggcaatactgagatggagaggcgggtggtgggggcggggtagtggtcatggctctggcaaccccttgtcctggcctggccccctcgtcctattcccagcaacccgtcctcccaccgatactgcacctgctgctccaccctgcctgccctagtgccccgggccaatactgggggaggcatgctgagcacccacatcaaggccatccccctcattagcaccaatggcccccaggagagggccctgtcccccacttccacagcagggactgggacagctgccgctctagagcaggtgcgtggcactcctgagtcgccctggctcctcccctaccatgtgtactcactcacacattcacgcagaggaacgcacacatacaccccacatcaccgagggggaagggaggggtccggggaggatgggatcacagctcatatgattggggagggtgggggagtcccaagtgcctataagaggctaaggctcttcaaggccttttctctgccgtgtccatggctgagaatggggatggaggggttggggtggggatggagggatggggaagacagcagacaggtcaggaattccactgggcccccaggcgtggtaggaaggtacaagagggcctacccatgggactggagtaatacaggattcagtactccaggagagagagagaggatagagacaaagacagcgcgggcagcccgaggccccagcagggtgggacaggcacatgcacaggtgacagcgggtgctcctccaggccctccacccctgttggaacacctgaacgattggggaaggacagtgccctgacgggcagcatagcattgccttcccatgtccgtgtgtgcatgtccgtgtgtgtgtgtgtgtgtgtgtgttacttttacaatcaggaaaacatatttaataacatatagtcaagaaaacagacttaaaaat

SEQ ID NO: 277391 - DNA, 3240 bp, Homo sapiens
cactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcaggtaggtcaggctctcgcctgaccgggggaggaggcagacgcagttcaattcaacacaccttttatggagtacctactctatgccaggccctgcaccgggcactggggatacagacatgattcagacacagtctagcttgggaaacagactcatgcccgactaattataaaacagtgagataagtgtcacagtagaagcatgaaccaaggaagcacagacaactatttctgcctgggggagctggggaaggaggtgacacttgagttggggcctcaaaggacaagtaagatgttgccaggcagagaaagggggaagggcatcccaggcagagggaactacacagcaaaaagcaagggagtctggccatgtttggcctgctgaggaagggaaggtggtcttacgggatgggaggtgaccagccctgctgagcccacgctcccagctttcaggcacctcctgctcttggggcagaggcctgggagaaggtatggcactccttctccttccccatcggccttctggggggcttcagggagaggctgcattgcctgccaggtcctcgcagacctccggttcctcctcagaggagctcggggagtccgcctcactgctgtcgtcttccccacagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatga

SEQ ID NO: 277392 - DNA, 3116 bp, Homo sapiens
  misc_feature (1520)..(1520): n is a, c, g, or t
ggccccgtttgatccccacacagctgggagggtggaggggctcttcccatgttacggacggggaagcgaagcctcttggaaagggcggggctcgcagttgcatcacagagacagaaggagctacaaagatgatgcagtcctttgaatcccagtcacccaggagagcttttcacaaacacagaccctttccttggaccccaggattttgatttgggatctggggaagggacctcacatctcttcccatcagctccccacacagccagctcataggccagtgatgaagccctcatcactcaggtgtggggaggaggacttgagctgcagatgtgacgctcctgacacgtcgcaggcacacggcaggtgtcggcctcctcgccagccctgggcaagatgggtcatcaggatgggaccgtgtggcacagcctgcgggctttggagccaggcaaacctgggctgggaatcctggctctgcctcggcctccgtgatcttagacaggcagccccagctccttgagacaccatttctctacaacgggatcacgctgcctgcctcgtgggatttccgtgggcactcagggtgcactggagctgggagcaaaggaggctctgtgagaggagggccagttcagccgcagcaggaggactgacaggggcctgatggaggagtttgtggggctgcgtgaaggctcctcagggaaccctgtgactctgcaggagctgtggggcccctgtcccctcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcgggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcggcaaagtgggccctttcgtgcacctgtctgtgatgatggctgcctacctgggccgtgtgcgcaccacgaccatcggggagcctgagaacaagagcaagcaaaacgaaatgctggtggcagcggcggcagtgggcgtggccacagtctttggcgctcccttcagcggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggngctggggggtctctgcggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacacgccactggaggaggtggtcaaggttgtgacctccacagacgtggccgagtatcccttggtggagagcacagagtcccagatcctggtgggcatagtgcgaagggcccagctggtgcaggccctgaaggctgagcctccttcctgggctcctggacaccagcagtgtctccaggacatcttggctgcaggctgccccacagaaccagtgaccctgaagctgtccccagagacttccctgcatgaggcacacaacctctttgagctgttgaaccttcattccctctttgtgacgtcgcggggcagagctgtgggctgcgtgtcctgggtggagatgaagaaagcaatttccaacctgacaaatccgccagccccaaagtgagccggcccagcaagatgaaacagggcaccccagctgacctggtactgaggttgggctgagaccctgcttctcttcccccatcaccacctgcccctccctccagcccagctccattctttggcataacaggcaactttaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgatgagattggagtacactgtcaccaagggcaggcacagatggcttctggggttgtctggttcccagtgagaggctcctgagaaaaataaagctggttcccaga

SEQ ID NO: 277393 - DNA, 2989 bp, Homo sapiens
  misc_feature (1393)..(1393): n is a, c, g, or t
ctctctacctgacacacagggaggctgtggtcatgctggccccactcaccattgcccccctgccttctccttcccttcccagcctcctcccctctccctctgtgctttttcaaaccttccatgtccagctctgagacccctggaccctgagtctcagccttggcagatgacccctctctgtcctgctgtgtgcatgagctcccccttcccagccctcgtccagcagcacccaggagcctgagtacagctgggcaccaccctctgtgcagctgtgatgggtggggaggctcctgctccccttctctcttggcagttctgccctgcacagctctggcctccacagttctggttggtttgtcaaggacgtttttaatctccatggtaaaccccggccggcggggaaggggggtggcagggagagagtgatgattggtagagcatatacctgtccaggtgcactggagctgggagcaaaggaggctctgtgagaggagggccagttcagccgcagcaggaggactgacaggggcctgatggaggagtttgtggggctgcgtgaaggctcctcagggaaccctgtgactctgcaggagctgtggggcccctgtcccctcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcgggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcggcaaagtgggccctttcgtgcacctgtctgtgatgatggctgcctacctgggccgtgtgcgcaccacgaccatcggggagcctgagaacaagagcaagcaaaacgaaatgctggtggcagcggcggcagtgggcgtggccacagtctttggcgctcccttcagcggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggngctggggggtctctgcggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacacgccactggaggaggtggtcaaggttgtgacctccacagacgtggccgagtatcccttggtggagagcacagagtcccagatcctggtgggcatagtgcgaagggcccagctggtgcaggccctgaaggctgagcctccttcctgggctcctggacaccagcagtgtctccaggacatcttggctgcaggctgccccacagaaccagtgaccctgaagctgtccccagagacttccctgcatgaggcacacaacctctttgagctgttgaaccttcattccctctttgtgacgtcgcggggcagagctgtgggctgcgtgtcctgggtggagatgaagaaagcaatttccaacctgacaaatccgccagccccaaagtgagccggcccagcaagatgaaacagggcaccccagctgacctggtactgaggttgggctgagaccctgcttctcttcccccatcaccacctgcccctccctccagcccagctccattctttggcataacaggcaactttaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgatgagattggagtacactgtcaccaagggcaggcacagatggcttctggggttgtctggttcccagtgagaggctcctgagaaaaataaagctggttcccaga

SEQ ID NO: 277394 - DNA, 2594 bp, Homo sapiens
  misc_feature (998)..(998): n is a, c, g, or t
ccataaaccctgggcccaggcgggaaaggggggaggatgttgattgttggaacacacacctgtccaggtgcaggggagctggaggctctgtgagaggagggccagctcagccacagcaggaggactgacaggggcctgatggaggagtttgtggggctgcgtgaaggctcctcagggaaccctgtgactctgcaggagctgtggggcccctgtcccctcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcgggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcggcaaagtgggccctttcgtgcacctgtctgtgatgatggctgcctacctgggccgtgtgcgcaccacgaccatcggggagcctgagaacaagagcaagcaaaacgaaatgctggtggcagcggcggcagtgggcgtggccacagtctttggcgctcccttcagcggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggngctggggggtctctgcggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacacgccactggaggaggtggtcaaggttgtgacctccacagacgtggccgagtatcccttggtggagagcacagagtcccagatcctggtgggcatagtgcgaagggcccagctggtgcaggccctgaaggctgagcctccttcctgggctcctggacaccagcagtgtctccaggacatcttggctgcaggctgccccacagaaccagtgaccctgaagctgtccccagagacttccctgcatgaggcacacaacctctttgagctgttgaaccttcattccctctttgtgacgtcgcggggcagagctgtgggctgcgtgtcctgggtggagatgaagaaagcaatttccaacctgacaaatccgccagccccaaagtgagccggcccagcaagatgaaacagggcaccccagctgacctggtactgaggttgggctgagaccctgcttctcttcccccatcaccacctgcccctccctccagcccagctccattctttggcataacaggcaactttaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgatgagattggagtacactgtcaccaagggcaggcacagatggcttctggggttgtctggttcccagtgagaggctcctgagaaaaataaagctggttcccaga

SEQ ID NO: 277395 - DNA, 1693 bp, Homo sapiens
cagaaagccttaacttgcctctagagaatgcctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacacgccactggaggaggtggtcaaggttgtgacctccacagacgtggccgagtatcccttggtggagagcacagagtcccagatcctggtgggcatagtgcgaagggcccagctggtgcaggccctgaaggctgagcctccttcctgggctcctggacaccagcagtgtctccaggacatcttggctgcaggctgccccacagaaccagtgaccctgaagctgtccccagagacttccctgcatgaggcacacaacctctttgagctgttgaaccttcattccctctttgtgacgtcgcggggcagagctgtgggctgcgtgtcctgggtggagatgaagaaagcaatttccaacctgacaaatccgccagccccaaagtgagccggcccagcaagatgaaacagggcaccccagctgacctggtactgaggttgggctgagaccctgcttctcttcccccatcaccacctgcccctccctccagcccagctccattctttggcataacaggcaactttaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgatgagattggagtacactgtcaccaagggcaggcacagatggcttctggggttgtctggttcccagtgagaggctcctgagaaaaataaagctggttcccaga

SEQ ID NO: 277396 - DNA, 2696 bp, Homo sapiens
  misc_feature (1520)..(1520): n is a, c, g, or t
ggccccgtttgatccccacacagctgggagggtggaggggctcttcccatgttacggacggggaagcgaagcctcttggaaagggcggggctcgcagttgcatcacagagacagaaggagctacaaagatgatgcagtcctttgaatcccagtcacccaggagagcttttcacaaacacagaccctttccttggaccccaggattttgatttgggatctggggaagggacctcacatctcttcccatcagctccccacacagccagctcataggccagtgatgaagccctcatcactcaggtgtggggaggaggacttgagctgcagatgtgacgctcctgacacgtcgcaggcacacggcaggtgtcggcctcctcgccagccctgggcaagatgggtcatcaggatgggaccgtgtggcacagcctgcgggctttggagccaggcaaacctgggctgggaatcctggctctgcctcggcctccgtgatcttagacaggcagccccagctccttgagacaccatttctctacaacgggatcacgctgcctgcctcgtgggatttccgtgggcactcagggtgcactggagctgggagcaaaggaggctctgtgagaggagggccagttcagccgcagcaggaggactgacaggggcctgatggaggagtttgtggggctgcgtgaaggctcctcagggaaccctgtgactctgcaggagctgtggggcccctgtcccctcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcgggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcggcaaagtgggccctttcgtgcacctgtctgtgatgatggctgcctacctgggccgtgtgcgcaccacgaccatcggggagcctgagaacaagagcaagcaaaacgaaatgctggtggcagcggcggcagtgggcgtggccacagtctttggcgctcccttcagcggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggngctggggggtctctgcggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacacgccactggaggaggtggtcaaggttgtgacctccacagacgtggccgagtatcccttggtggagagcacagagtcccagatcctggtgggcatagtgcgaagggcccagctggtgcaggccctgaaggctgagcctccttcctgggctcctggacaccagcagtgtctccaggacatcttggctgcaggctgccccacagaaccatatctgccaggtgctcagtgactggccatcacattaatgaatgatgagattggagtacactgtcaccaagggcaggcacagatggcttctggggttgtctggttcccagtgagaggctcctgagaaaaataaagctggttcccaga

SEQ ID NO: 277397 - DNA, 1799 bp, Homo sapiens
ctctctacctgacacacagggaggctgtggtcatgctggccccactcaccattgcccccctgccttctccttcccttcccagcctcctcccctctccctctgtgctttttcaaaccttccatgtccagctctgagacccctggaccctgagtctcagccttggcagatgacccctctctgtcctgctgtgtgcatgagctcccccttcccagccctcgtccagcagcacccaggagcctgagtacagctgggcaccaccctctgtgcagctgtgatgggtggggaggctcctgctccccttctctcttggcagttctgccctgcacagctctggcctccacagttctggttggtttgtcaaggacgtttttaatctccatggtgcactggagctgggagcaaaggaggctctgtgagaggagggccagttcagccgcagcaggaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgagcacaccagtggctgtacagggagattggggacagccacctgctccggtatctttcctggactgtgtaccctgtggccctcgtctctttctcctcaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtggtatggtcagggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactaggtcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcag

SEQ ID NO: 277398 - DNA, 1779 bp, Homo sapiens
ctctctacctgacacacagggaggctgtggtcatgctggccccactcaccattgcccccctgccttctccttcccttcccagcctcctcccctctccctctgtgctttttcaaaccttccatgtccagctctgagacccctggaccctgagtctcagccttggcagatgacccctctctgtcctgctgtgtgcatgagctcccccttcccagccctcgtccagcagcacccaggagcctgagtacagctgggcaccaccctctgtgcagctgtgatgggtggggaggctcctgctccccttctctcttggcagttctgccctgcacagctctggcctccacagttctggttggtttgtcaaggacgtttttaatctccatggtgcactggagctgggagcaaaggaggctctgtgagaggagggccagttcagccgcagcaggaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgagcacaccagtggctgtacagggagattggggacagccacctgctccggtatctttcctggactgtgtaccctgtggccctcgtctctttctcctcaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtggtatggtcagggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactaggtcggagcctgtgtactccgctctggccaccttgcttctcgcctccatcacctacccgcctggtgtgggccacttcctagcttctcggctgtccatgaagcagcatctggactcgctgttcgacgatggctcctgccttgaaagacaaaaatcccaccttgggcagagctgagtgtgagaagatggaaaaccagtatctgccaggtgctcagtgactggccatcacattaatgaatgatgagattggagtacactgtcaccaagggcaggcacagatggcttctggggttgtctggttcccagtgagaggctcctgagaaaaataaagctggttcccaga

SEQ ID NO: 277399 - DNA, 1192 bp, Homo sapiens
ctctctacctgacacacagggaggctgtggtcatgctggccccactcaccattgcccccctgccttctccttcccttcccagcctcctcccctctccctctgtgctttttcaaaccttccatgtccagctctgagacccctggaccctgagtctcagccttggcagatgacccctctctgtcctgctgtgtgcatgagctcccccttcccagccctcgtccagcagcacccaggagcctgagtacagctgggcaccaccctctgtgcagctgtgatgggtggggaggctcctgctccccttctctcttggcagttctgccctgcacagctctggcctccacagttctggttggtttgtcaaggacgtttttaatctccatggtaaaccccggccggcggggaaggggggtggcagggagagagtgatgattggtagagcatatacctgtccaggtgcactggagctgggagcaaaggaggctctgtgagaggagggccagttcagccgcagcaggaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgaggcttctcccagagcatcacgccctcctctggaggtgagtccacggtcgccatgccagtccccagtgccaaaaccttctcagatcccagggggcttctgatggggggagtcgggaaggggcagcctcatttcacagacaaaggcccaggaagagtcatgtggcttgcccaaagggacacagcaagaaggccagatcttgacttttgggtcactgctggccctacctgctttccaggggctccgctgggacttgatgggaggcctggtgggaggatcttctgcgaagcctgttccagtggccagtgccagggaggggccagtggaggaggcacagctcccccaggccgctcagccctgcctcctgctccaggccagcagaggggagctcaaagctcactcagtggtggcctgagatttcatccgggcttccc

SEQ ID NO: 277400 - DNA, 558 bp, Homo sapiens
gctgtcccctgccagcccccatggggacctggattctgtgcctgcactccctctgactctcagaacattcagcagccccaagaggacaaagttggcagctttctccttaaaggtctagaaggttgtgttcccggcaactgtctgctccatctctgtgtcagaggtgatgcctgcgagcgccttaggtgggatttcagtcagaggtaaaagagaattccggaagacaattattctagccctgagttctagaatgccttctgggcatgggctcctggctgcaagctgtccagcacggccccgtttgatccccacacagctgggagggtggaggggctcttcccatgttacggacggggaagcgaagcctcttggaaagggcggggctcgcagttgcgtaagtggcagagctgggattcgaacctagatgtgttggacccaaagcccttcagaggccgaggtggtttgaacatgtgcctatggagacaggctggcccggaagagccagagaagcccctccctacccacctgcttgctcagcaaagctgggactgaccttgc

SEQ ID NO: 277401 - DNA, 827 bp, Homo sapiens
ccctcggcccagctgagagcctggaggaggggatggggctcattcttgttctcacttcagccccgctttgggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactaggtcggagcctgtgtactccgctctggccaccttgcttctcgcctccatcacctacccgcctggtgtgggccacttcctagcttctcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcag

SEQ ID NO: 277402 - DNA, 2545 bp, Homo sapiens
  misc_feature (949)..(949): n is a, c, g, or t
tccaggtggtacgctccgggtaacgggagctggaggctctgtgagaggagggccagctcagccacagcaggaggactgacaggggcctgatggaggagtttgtggggctgcgtgaaggctcctcagggaaccctgtgactctgcaggagctgtggggcccctgtcccctcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcgggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcggcaaagtgggccctttcgtgcacctgtctgtgatgatggctgcctacctgggccgtgtgcgcaccacgaccatcggggagcctgagaacaagagcaagcaaaacgaaatgctggtggcagcggcggcagtgggcgtggccacagtctttggcgctcccttcagcggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggngctggggggtctctgcggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacacgccactggaggaggtggtcaaggttgtgacctccacagacgtggccgagtatcccttggtggagagcacagagtcccagatcctggtgggcatagtgcgaagggcccagctggtgcaggccctgaaggctgagcctccttcctgggctcctggacaccagcagtgtctccaggacatcttggctgcaggctgccccacagaaccagtgaccctgaagctgtccccagagacttccctgcatgaggcacacaacctctttgagctgttgaaccttcattccctctttgtgacgtcgcggggcagagctgtgggctgcgtgtcctgggtggagatgaagaaagcaatttccaacctgacaaatccgccagccccaaagtgagccggcccagcaagatgaaacagggcaccccagctgacctggtactgaggttgggctgagaccctgcttctcttcccccatcaccacctgcccctccctccagcccagctccattctttggcataacaggcaactttaacctagcccagaagaggatggctcatcctgggtgggacgatggctcctgccttgaaagacaaaaatcccaccttgggcagagctgagtgtgagaagatggaaaaccagtatctgccaggtgctcagtgactggccatcacattaatgaatgatgagattggagtacactgtcaccaagggcaggcacagatggcttctggggttgtctggttcccagtgagaggctcctgagaaaaataaagctggttcccaga

SEQ ID NO: 277403 - DNA, 2660 bp, Homo sapiens
  misc_feature (1520)..(1520): n is a, c, g, or t
ggccccgtttgatccccacacagctgggagggtggaggggctcttcccatgttacggacggggaagcgaagcctcttggaaagggcggggctcgcagttgcatcacagagacagaaggagctacaaagatgatgcagtcctttgaatcccagtcacccaggagagcttttcacaaacacagaccctttccttggaccccaggattttgatttgggatctggggaagggacctcacatctcttcccatcagctccccacacagccagctcataggccagtgatgaagccctcatcactcaggtgtggggaggaggacttgagctgcagatgtgacgctcctgacacgtcgcaggcacacggcaggtgtcggcctcctcgccagccctgggcaagatgggtcatcaggatgggaccgtgtggcacagcctgcgggctttggagccaggcaaacctgggctgggaatcctggctctgcctcggcctccgtgatcttagacaggcagccccagctccttgagacaccatttctctacaacgggatcacgctgcctgcctcgtgggatttccgtgggcactcagggtgcactggagctgggagcaaaggaggctctgtgagaggagggccagttcagccgcagcaggaggactgacaggggcctgatggaggagtttgtggggctgcgtgaaggctcctcagggaaccctgtgactctgcaggagctgtggggcccctgtcccctcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcgggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcggcaaagtgggccctttcgtgcacctgtctgtgatgatggctgcctacctgggccgtgtgcgcaccacgaccatcggggagcctgagaacaagagcaagcaaaacgaaatgctggtggcagcggcggcagtgggcgtggccacagtctttggcgctcccttcagcggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggngctggggggtctctgcggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacacgccactggaggaggtggtcaaggttgtgacctccacagacgtggccgagtatcccttggtggagagcacagagtcccagatcctggtgggcatagtgcgaagggcccagctggtgcaggccctgaaggctgagcctccttcctgggctcctggacaccagcagtgtctccaggacatcttggctgcaggctgccccacagaaccagtgaccctgaagctgtccccagagacttccctgcatgaggcacagatggcttctggggttgtctggttcccagtgagaggctcctgagaaaaataaagctggttcccaga

SEQ ID NO: 277404 - DNA, 1871 bp, Homo sapiens
ctctctacctgacacacagggaggctgtggtcatgctggccccactcaccattgcccccctgccttctccttcccttcccagcctcctcccctctccctctgtgctttttcaaaccttccatgtccagctctgagacccctggaccctgagtctcagccttggcagatgacccctctctgtcctgctgtgtgcatgagctcccccttcccagccctcgtccagcagcacccaggagcctgagtacagctgggcaccaccctctgtgcagctgtgatgggtggggaggctcctgctccccttctctcttggcagttctgccctgcacagctctggcctccacagttctggttggtttgtcaaggacgtttttaatctccatggtaaaccccggccggcggggaaggggggtggcagggagagagtgatgattggtagagcatatacctgtccaggtgcactggagctgggagcaaaggaggctctgtgagaggagggccagttcagccgcagcaggaggactgacaggggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgagcacaccagtggctgtacagggagattggggacagccacctgctccggtatctttcctggactgtgtaccctgtggccctcgtctctttctcctcaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtggtatggtcagggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactaggtcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcag

SEQ ID NO: 277405 - DNA, 1375 bp, Homo sapiens
aagcaggctggtacggtccggaggagttatgggcctgatggaggagttggtggggctgcgtgagggcttctcaggggaccctgtgactctgcaggagctgtggggcccctgtccccacatccgccgagccatccaaggtggcctggagtggctaaagcagaaggtgttccgcctgggagaagactggtacttcctgatgaccctcggggtgctcatggccctggtcagctatgccatgaactttgccatcgggtgtgtggtccgagcacaccagtggctgtacagggagattggggacagccacctgctccggtatctttcctggactgtgtaccctgtggccctcgtctctttctcctcaggcttctcccagagcatcacgccctcctctggaggttctggaatcccggagctgaagaccatgttggcgggtgtgatcttggaggactacctggatatcaagaactttggggccaaggtggtgggcctctcctgcaccctggccaccggcagcaccctgttcctgggcaaagtggtatggtcagggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactaggtcggctgtccatgaagcagcatctggactcgctgttcgacaaccactcctgggcgctgatgacccagaactccagcccaccctggcccgaggagctcgacccccagcacctttggtgggaatggtaccacccgcggttcaccatctttgggacccttgccttcttcctggttatgaagttctggatgctgattctggccaccaccatccccatgcctgccgggtacttcatgcccatctttatccttggagctgccatcgggcgcctcttgggagaggctcttgccgtcgccttccctgagggcattgtgactggaggggttaccaatcccatcatgcccggggggtatgctctggcag

SEQ ID NO: 277406 - DNA, 1026 bp, Homo sapiens
gcatctctgggtgggcaacttacccgagaacgtgcgggaagagaagatcatcgagcatttcaaacggttctggaatcccggagctgaagaccatgttggcgggtgtgatcttggaggactacctggatatcaagaactttggggccaaggtggtgggcctctcctgcaccctggccaccggcagcaccctgttcctgggcaaagtggtatggtcagggccctttcgtgcacctgtctgtaatgatcgctgcctacctgggccgtgtgcgcaccacgaccatcggggagcctgagaacaagagcaagcaaaacgaaatgctggtggcagcggcggcagtgggcgtggccacagtctttgcagctcccttcagcggcgtcctgttcagcatcgaggtcatgtcttcccacttctctgtccgggattactggaggggcttctttgcggccacctgcggggccttcatattccggctcctggcagtcttcaacagcgagcaggagaccatcacctccctctacaagaccagtttccgggtggacgttcccttcgacctgcctgagatcttcttttttgtggcgctgggtggcatctgcggcgtcctgagctgtgcttacctcttctgtcagcgaaccttcctcagcttcatcaagaccaatcggtacagctccaaactgctggctactaggtcggagcctgtgtactccgctctggccaccttgcttctcgcctccatcacctacccgcctggtgtgggccacttcctagcttctcggctgtccatgaagcagcatctggactcgctgttcgacgatggctcctgccttgaaagacaaaaatcccaccttgggcagagctgagtgtgagaagatggaaaaccagtatctgccaggtgctcagtgactggccatcacattaatgaatgatgagattggagtacactgtcaccaagggcaggcacagatggcttctggggttgtctggttcccagtgagaggctcctgagaaaaataaagctggttcccaga

SEQ ID NO: 277407 - DNA, 769 bp, Homo sapiens
ggtctcgatctcctgacctcgtgatcctcctgcctcggcctcccaaagtgctgggattacaggagtgagccaccgcaactggcctggcagttccttatttatatactttgatctatgccccggaaacatgcccctgtcctctaccaagtaccttcctctacgtaccccaatttgtaacagcatttgttgccctctagtactagtatcgatttctctggtttttcccatttgactgtaagatcctttcaagttatcttattcctactaccacttaaaaatgacagtgtatgaatcactcattgacacttaacttgtgaagaggaaaaaggggcgtttccacttagaattaactcataactcaaattcttagtatacttatagctgtctgaaaagctgaagaatcttttagtctaagccaaaacatctgcttactctttttgtttttgttttttgaggtttgagtcttgctctgtagccctggctggagtgcagtggtataacctcggctcactgcaacctccacctcccgagctcaggcaattctcctgcctcagcctcccgagtagctgggattacaggcatgcaccatcacgtccagctaattttgtatttttagtagagatggggtttcaccatgttggccaggctggtcttgaactcctaacttcaggtgatctgcccacctcagcctcccaaagtgctgggattacaggtgtgagccgccatgcccggcctgcttactcattttgaaatggagaaattaccattt

SEQ ID NO: 277408 - DNA, 720 bp, Homo sapiens
aaaaacaaaagcttaagtcagtaaatcttttatcaagttacacaaatcaaattactttgttactaggaaacttcaatttttctaatggtaacatgatttctaataaactgaaatgtcacaaataaagcaagaaatccaatttaacactctcattcttataaacgcaatcatgtccaatccaaataccccatcccagcctagtctcctcctcactctgaatcccattcacacagtatgtgaacctctgccttgtccagtagtataacatggtgaacaagtggtttttatcacatgcttctcatctatgttccctttcatacctgttttatcataagagtacttttgattccagaacatatcacaagttagttccgtatttctttctttctttctgagatggagtcttactctgtcgcccaggctggagtgcagtagcgcgatctcggctcactgcaacctccacctcccggattcaagcgattctcctgcctcagcctcccgagtagctgggactacaggcatgcaccatcacgtccagctaattttgtatttttagtagagatggggtttcaccatgttggccaggctggtcttgaactcctaacttcaggtgatctgcccacctcagcctcccaaagtgctgggagccgaggcaggcagatcacccgaggtcaggagcttgagactagactgaccaacacggagaaaccttgtctctac

SEQ ID NO: 277409 - DNA, 966 bp, Homo sapiens
ccctccactgtcctcctggttctagaatcccactgctattccataccaggcactttagaaccagagactctgctgcttttcctgggcagggcctgcttgctccagctctcaagtctgacttgcatctacactgcgggcaagatgtggctgcaagaccgcatcgccacgttcttcttcccaaaaggcatgatgctcaccacggctgcgctgatgctcttcttcttacacctgggcatcttcatcagagacgtgcacaacttctgcatcacctaccactatgaccacatgagctttcactacacggtcgtcctgatgttctcccaggtgatcagcatctgctgggctgccatggggtcactctatgctgagatgacagaaaacaatgctcaacggagccatgctcttcaaccgcctgtccttggagtttctggccatcgagtaccgggaggagcaccactgaggcctggggagtcggaacagggctaaggagggggaagcaaaaggctgcctcgggtgttttaataaagttgttgtttatttccacctgccagctccttcatggggcgaggggtcggaggctggagacccgggaggaaagcaagtcaagacaaatgcttgacccacggggactccaggcctggcctgcagccactctggtggacttggctttgggtctggggtcttagtgtcttaggcttgagggagaggggcagtgaagaggtgccctcagcctccccattaccccgcctctcctccacagaacccacatcctaggctggcctagccacaagcaagggggctcaggaggggcccacgcggatgtgagggttcatgagtgggtccaggttgggatcgctgtcagctgcggcccggcctaggcgagacatgagggcaaggagggccaggaagcccagcagtcccaagagtagcagcagccccgcccgctggagcagggtcagcggccgc

SEQ ID NO: 277410 - DNA, 1117 bp, Homo sapiens
ccctccactgtcctcctggttctagaatcccactgctattccataccaggcactttagaaccagagactctgctgcttttcctgggcagggcctgcttgctccagctctcaagtctgacttgcatctacactgcgggcaagatgtggctgcaagaccgcatcgccacgttcttcttcccaaaaggcatgatgctcaccacggctgcgctgatgctcttcttcttacacctgggcatcttcatcagagacgtgcacaacttctgcatcacctaccactatgaccacatgagctttcactacacggtcgtcctgatgttctcccaggtgatcagcatctgctgggctgccatggggtcactctatgctgagatgacagaaaacaagtacgtctgcttctccgccctgaccatcctgagtgagtggcaggagggggagggtgcaagagggagcggggagctttggaaccctgagatgtggcaaggagtagccagggaagggtactggggctcatggggggctctgtcccccgcccagtgctcaacggagccatgctcttcaaccgcctgtccttggagtttctggccatcgagtaccgggaggagcaccactgaggcctggggagtcggaacagggctaaggagggggaagcaaaaggctgcctcgggtgttttaataaagttgttgtttatttccacctgccagctccttcatggggcgaggggtcggaggctggagacccgggaggaaagcaagtcaagacaaatgcttgacccacggggactccaggcctggcctgcagccactctggtggacttggctttgggtctggggtcttagtgtcttaggcttgagggagaggggcagtgaagaggtgccctcagcctccccattaccccgcctctcctccacagaacccacatcctaggctggcctagccacaagcaagggggctcaggaggggcccacgcggatgtgagggttcatgagtgggtccaggttgggatcgctgtcagctgcggcccggcctaggcgagacatgagggcaaggagggccaggaagcccagcagtcccaagagtagcagcagccccgcccgctggagcagggtcagcggccgc

SEQ ID NO: 277411 - DNA, 342 bp, Homo sapiens
tgagttaggcttcagaggcagcgctgggtaggcctgagaggagcaagcacagtgggaggcccaacctcagaccacactcatctggatttccagaggtctccaggaggcaaggactatttggtggccctgcttcacccaactgctcttctagcattctccacatcatgtgctatgagttggattcgatcagaattctcaccactggttctaagtcagaatcatctggagagcaagaagcagaatgtctgaaatcttcctatggtacagaactgctggatgagaccatcagtgggaatttggctatgaatgacaaataaataaaaatatgcctacatctaaaaa

SEQ ID NO: 277412 - DNA, 621 bp, Homo sapiens
tgagttaggcttcagaggcagcgctgggtaggcctgagaggagcaagcacagtgggaggcccaacctcagaccacactcatctggatttccagaggtctccaggaggcaaggactatttggtggccctgcttcacccaactgctcttctagcattctccacatcatgtgctatgagttggattcgatcagaattctcaccactggttctaagtcagaatcatctggagagcaagaagcagaatgtctgaaatcttcctatggtacagaactgctggatgagaccatcagtgggatccctcacctgcaggccatgaggaccgttttatgggctctaaactgctcacggctcacaacaatgacaacatcagtcaagatgtctcgactccggagacgattaaggttgagaagaacatcactggcatggcgggtgaactggatacagctgtcagccggcgaggccattttgtcttcacttgaaaaaagaggccaaaatcctgttagtcctccagaacctgtttcctgcttgccacaggtatcagagcaggtggcttagcctgctaaggtacagaatgcaactcaggtcccttgtgtttgatctttgaacaattcatagtccaaaa

SEQ ID NO: 277413 - DNA, 946 bp, Homo sapiens
tgagttaggcttcagaggcagcgctgggtaggcctgagaggagcaagcacagtgggaggcccaacctcagaccacactcatctggatttccagaggtctccaggaggcaaggactatttggtggccctgcttcacccaactgctcttctagcattctccacatcatgtgctatgagttggattcgatcagaattctcaccactggttctaagtcagaatcatctggagagcaagaagcagaatgtctgaaatcttcctatggtacagaactgctggatgagaccatcagtggggtaagctcaaatactccatgataattcaagacatgattaactataatagtctccagttcttgttgaggttttgtcaagcccatgatggcctggtatgtaagttcttggtgattcctatttcttaaagacctacctagatctacagctttctcccatctgcatgatcaaagtgtgtcgttcacagagcacaattattttgtcctgtcgtgctcttttggacagagacccaccagtgacataaaagacaaaactagctagagaagaaaaaagagacgtattgcctgatcttagctgagtgccatgaccttcttgttccccattcacctcatctgtaaagagggaagacaaacccacttcagtgagttgtcgtgagggtaattgagaccgtgagtgtaaagcctactggcaatgagaaggctctccaaatctcaattccctgagtctttgacagcgagaagaaagtgaaaacgagaagctagggtggtgccttttctgagagcatttttcttcatctttcttcccatgaacagcctctgttgaattgtatcatgtccccacaaaattcatacgttgaagtcctaacttctagtaccttagaatgtgaccttatttggaaatagggtcgttgcagatataattagttaagttgagat

SEQ ID NO: 277414 - DNA, 1844 bp, Homo sapiens
ttggtttttttttggcttttatttttgtgtgtgtggattaccaccatatagctcaccatgttatcccagaaagactacaatttcatacagaatgcacagatgtttaaataaaaagccatttaagtgaggggataattctcactaaaaaaagctcaaaaataagaaatgacaattctagatacacttttttgacatgtaaaatgacataaccatagtcacagggaataaagaatcaggtttgaatgtccacaggtttctaaaactaagctctggcttcgtatctgttgaaaatctttagcggttggggaaaatagctatatttaaaaacaaatattgaattttgagttgaaaggtacattttcctcccttgatggagacagaacttttctatggagaacccaagcagcctttccatgatcttactaagttgtccaagagccaaccccgatcagcagcaacaggactcaagctgttcaccctgctttcgagttggctgagcttcctgctgctttcacacattcttctttttctacctcagttcctctttgcttgtagtctttcactccattaacttgcccaagcactggacttaagtatggaagagcctatacgcagttgtaatatatttcgtattttgaaagtgtagaagtttgtattaatttaaaaagaaaaagcttaaatggaaagttaagcaatcctgaacaagaaaactctctcactgcctttgggctagagaaagagtatgctctcaaggagttacataatcttttccaaagcaggatggactgtatctatcatacacattaggataagatgagccaccacaccttaaagaaatcaggcttgagcctatacaagccataaccaaatagaagattttaaacaaaggagcacatagcccaaagctgacatgttatttctataaactctggtatatatgtgaaggagttactgttggctggcttgtgggttttttgactcactacatttttttagacaaaatcacaatgtgaaggcacattaatagttgagattttcttttccttccaggtggacttgctgactgattagtttcatatactacttagtaacctcaagaagtagcaggaggatgccatgtatcaatcttgaacttcaagtctcactgcaacaaggatggagactccagcagagtgcagggtgggcacagacaggccacaagatggcgcagcacctccatacttgggctcttgacaaccaagtactgctgaagttgtagcaggaactactagtccttcactgaggcatgtagccgccttgccgtacagtctgtgtacctggaccaaaagcatctgctgcagaaacttcctgaaacattttcatttgcccagatccacaggattgtgaaatatgatctgaaatctgctgtttaagtctaacaaaatcttcctcattgactgatgaaacttgctttgacctttcaaaatgtgaaatatctggactggattcatgctgactgcagttctgtttgaagtactgttgcctgggcaaaataccatcaccgccatctacatgatctactaattgtagatcttctggccgctcctctgaatctaacaagggctgggtagactcggatcttgagaagacttggactgacggaacttggtgtctgtagccactgtgtaccacggtagaatactggacagtgctcgaagtgttttgtgaagattcattttcatcactgctagaaatgcttggcctagaagatgacatgcatgaagaccccccaataccactgctgtgtccttcagtattaattttttcctttttgaacaggtccaatgatttcagatcttctggaa

SEQ ID NO: 277415 - DNA, 1124 bp, Homo sapiens
aatgtgccttcttacagggcctcggggagtctgggatgttcctggggtcatctgtgttctttgccattgctgacgctgtggccgcagtgcgaagagaaagagacatagctgaggacttcacggtgaagagcccagcaacgccagaatgggttcgaatggcctgtgcagatcgattcacagaaatgcaatgattacaatcacctgcctctggacagatgccctcctcagatgggcagggccgggaaaccagcaccctccacccactccaggaactcctctgtgcggatcttggcctagagatcccaagagatgaccctgagacatttaaaccttggtctatccctatagcataacactgctatcattccctaaaaggtgtttcagtttttcacaagtaaaaagatggcttgttaatcctaactgggttccaaacttatattcttatactgttgtagaaaaaaatagacacaaaatttagaaacgttatccaactttgattatgttaacccaatgaatcattatttgcaaagcatttcacttagactttccagcctagaggccaccagaaaagcactgctgtatccacagtaagcaagtttagtgctgatttgtttctgaaaagatcacgtaaatgttgctgtaaaagcaaacttttcctttctgtgtccatccaatctaaatgggctggtaatacaggttatgattatagaatgaaagacacttcttggtagataaatatatgatgacttttcccaggggtgtatttggttcagtagccacaagagagttctgcaggttttgttttgccatggattgaccataagtctatgtacgtgcatttgacagcaaaggagtggtatttccctcatgcacatctactattcaactgattaacattcttttggatttggaggaggggaaaaagcaatataaaaacattttcaatatcttgcccccaacccctctgtgttggtgttgctgttgttgaaaaacatccaatctggtatcagagtttaagaaatattgcatatttcagtttcccatagattgaagtgagaacataaagcaaaagaattataatggaattaccccctacattgtggtttatgcgatcctctctacca

SEQ ID NO: 277416 - DNA, 912 bp, Homo sapiens
atctgcaggagcaggatgcaggcctccctctggatggctcccttccagtggcacagagaccagctcacctccaatgacaaggaagagtatcagcatgacgggatagaagaaccccaggacgaagcagaagatatactcatgggccactgcggagaccaggaacacacccagcatggctacccctcgggcccgggcaccaaggagctggcagggtgctgcctccaaggccccgaaacagagagtgctactgcgaacaaatcaacctcttccactccactgctgcttttggtgccccataacgacgaccccctctcagcaggaagtagccagaaagattacgactccccatctccctgcgattctcatgataaataaatatccatgcatgataaaaatcgtgtaaattgacagtggggactgtgacaagcaggtctcactaatgcagacctccataacaactgtttcagtactgactgagtggttaagttaaatgttaaaaaccagtgcccttatacaaaggctggaatgtaacaaaagcccaccaagagttttgcctaggcctttcctgaacctcaaagcatgattaaacaagttttgctgggggtctgaagaaactccccaaacctccgttatttagcaggagataagagaagggtaatcaccccagcacctggacccatttagattaagtaaacttactgaggctccagaagaaggtcttcaagactcagaccttagttatagattaaaagaagttaatcacttatgtctttagatgaatgcacacctacacatagatgtagagcttagaaggatatatgctctggaaattgtaatttttagtggcctgtgataatttccaggccttctccctgtaactggttacagaaataaaaactcacttcctcccca

SEQ ID NO: 277417 - DNA, 885 bp, Homo sapiens
agagaccgggatggtgctgtgttcagccaccagtggcttgcgatgagacagtcttcaggagggtccaagcagctgcccgtgagatttttcctggggaccctcccgagggctgtcccgtgtgcaaaactgcacgtccctttcactactggggaagaacagagatcagaagcagacacgctcaaagggtgctgcctccaaggccccgaaacagagagtgctactgcgaacaaatcaacctcttccactccactgctgcttttggtgccccataacgacgaccccctctcagcaggaagtagccagaaagattacgactccccatctccctgcgattctcatgataaataaatatccatgcatgataaaaatcgtgtaaattgacagtggggactgtgacaagcaggtctcactaatgcagacctccataacaactgtttcagtactgactgagtggttaagttaaatgttaaaaaccagtgcccttatacaaaggctggaatgtaacaaaagcccaccaagagttttgcctaggcctttcctgaacctcaaagcatgattaaacaagttttgctgggggtctgaagaaactccccaaacctccgttatttagcaggagataagagaagggtaatcaccccagcacctggacccatttagattaagtaaacttactgaggctccagaagaaggtcttcaagactcagaccttagttatagattaaaagaagttaatcacttatgtctttagatgaatgcacacctacacatagatgtagagcttagaaggatatatgctctggaaattgtaatttttagtggcctgtgataatttccaggccttctccctgtaactggttacagaaataaaaactcacttcctcccca

SEQ ID NO: 277418 - DNA, 1327 bp, Homo sapiens
tgagatactttttccagtttgagcgctggcttgtggggagagtgcacactctgagagcagtttttcccacagaggatatgtgtacaggctttgtccctggcaccaaaactctggtgactcatcttctcctgggatggggttttctcctcactctcccctggagaatttctacattgccttcttgatgttggctcactctccaagcctttttgtagctcagagtgcccaataaactcctctggactttctctgtaaagccttgtttatttctacttcctctgaatcatcccattttagattttcttttttaatctcgttcttgaactcaaaacctgaaaaaaaaaaaccccacagaaatacaatggactatagagaaggaaaacaatggaatgcaaagttataactatactacgtagaagaaatatctaattgaaattcttcatgtgattaagtctcctgctaattaatagctttttattttctcattgtaatatttttgagctccaaattattacaggaaaattatgccctaaactccaacttttctcctatcttttttcggatgttctgacacaatgacaaactgaggcaagacattaagcactatatcatctgccagtctgtttataggtgtaccctcaattcttgaatgttctaacttctagcagcagaataacaaaaggcaaccctgggcttggccagctcaaacaggaagaaagcaaggtgctaagtacccagccagcataggctcaggctgtgaaaggcaaggccatgctagagaaaaagggagaagatggacctggtctggaggcctaaccagcagtctgacaatgcatagtgaaactccatgggaaaagatgacatgaacttagttgaaagaggttggcaaatgcaaaatcagggctgtaaaatgcaaggggaataacctttaactccatgaaaaccaaaacttggatagggtcacacatcaagatgatgatgatgccaggatcagtgacagctcctactcaactgctaggctaatggcctctaaagtggactttgccatcctttgaccatcagagccaagggagtcttaccaagtctgtttgggaacagcactggcaggtctagtttcctgacttcctggccaggattcctgaagtccttttcatccctgtctgcaccatccacagtgccatcttctacctccgtgggttccccattctggtgattcagctctccagcctcaatatcacttccttcttggccaggaacagcatcgcttgccataggaggtgcagaggcccaggagcctgaaagagcattcatttcctcatgaaagata

SEQ ID NO: 277419 - DNA, 783 bp, Homo sapiens
tccggcgtgctccgcaacagcttccggcgtgacgcagtagaaaaggtggcgtggctggcgattcgtgttcgtgagggccttttctggtgtaccctcaattcttgaatgttctaacttctagcagcagaataacaaaaggcaaccctgggcttggccagctcaaacaggaagaaagcaaggtgctaagtacccagccagcataggctcaggctgtgaaaggcaaggccatgctagagaaaaagggagaagatggacctggtctggaggcctaaccagcagtctgacaatgcatagtgaaactccatgggaaaagatgacatgaacttagttgaaagaggttggcaaatgcaaaatcagggctgtaaaatgcaaggggaataacctttaactccatgaaaaccaaaacttggatagggtcacacatcaagatgatgatgatgccaggatcagtgacagctcctactcaactgctaggctaatggcctctaaagtggactttgccatcctttgaccatcagagccaagggagtcttaccaagtctgtttgggaacagcactggcaggtctagtttcctgacttcctggccaggattcctgaagtccttttcatccctgtctgcaccatccacagtgccatcttctacctccgtgggttccccattctggtgattcagctctccagcctcaatatcacttccttcttggccaggaacagcatcgcttgccataggaggtgcagaggcccaggagcctgaaagagcattcatttcctcatgaaagata

SEQ ID NO: 277420 - DNA, 391 bp, Homo sapiens
tcctggggaaggggctgctgcgggggcgactgctgtgggggctgagcgggggcctgcgccgcttggccttcaggatcttgttcacgtggtccaggttcttcttggtggacaggatcttggtgtagttgcacatcttccgcacttcgcactggatggcttcgatctcccgccgcttgaacctcttcttcagggaggagccgactgcgggaggggaagagataagaaattgagcacaggatgcaaggtgccttcaactcagcctcttcactgacagctagcattctacttggctataaagattatagagaattaatgctatgggtatgtctccgtgcccaagatgcattattcctttttctttattaaaataaaaacaaacatttctcaaata

SEQ ID NO: 277421 - DNA, 657 bp, Homo sapiens
gggcaggagtggcgctgtatccacattcacttcagaagttgaagattccaaataggagaataagtggggagaggggagacaaggaagagggtttggccctgcttcagggcccactgggtgggtaggtgtggggaggaagatggggacagatgggaggagagctcagagccagggttcacccaccgcccccaggcttcttcagatagtcaccaccaccccggccatcagtggagatttcccggaaaacagtgagcatggagtgccggactctgtcagccagagctgggacgtcatctggtgtcagcccttccgtgggcactgggggcagcacccgcacctgacattgtcctggggcaaggggagcaccatcatggcctgtccacccaggtctttgcccacaggtggggcccagcttccgagtgatactcttcctcaacctttcagttctcttcccccaaccctggacaaccatccctgggcttgccagctgccacttctgaggcccttctcctatacaaagccttctccaatccccagttcagacatctcctcagcacccctccagcccccctcctctgggtttggcatttactgctgaatgagtgttattcattacagctttgtgcacacaggccttatctttcctgttaagattag

SEQ ID NO: 277422 - DNA, 560 bp, Homo sapiens
gggcaggagtggcgctgtatccacattcacttcagaagttgaagattccaaataggagaataagtggggagaggggagacaaggaagagggtttggccctgcttcagggcccactgggtgggtaggtgtggggaggaagatggggacagatgggaggagagctcagagccagggttcacccaccgcccccaggcttcttcagatagtcaccaccaccccggccatcagtggagatttcccggaaaacagtgagcatggagtgccggactctgtcagccagagctgggacgtcatctggtgtcagcccttccgtgggcactgggggcagcacccgcacctgacattgtcctggggcaaggggagcaccatcatggcctgtccacccaggtctttgcccacagggatgtcctcccagcctctccggacacaccctaccccagaactgctcaaagccctcacccgaggtgaagcgacgctccttcttgcagtagaagtcttggatgactcacgtcctgggtgagcagggtctgggcgacctcagacatgacactgatggcatc

SEQ ID NO: 277423 - DNA, 1681 bp, Homo sapiens
  misc_feature (186)..(186): n is a, c, g, or t
ggcaggagggaaaggttatgggtcggcccggcggtctctcccagcacccgcgactctcaccttgctcagctgctggtggatgagctgcttcagctcggaggctttctccggaggcagcgacatgctggcagccggcgtctccccgccgcttctccccgcctcagatgccctaactgcgcggccccngccgggccagggagcgttaggagcgactgagcacaaagcgccgcagccgttcgcctagcgcagctcccgggggacgcaacgccgcgtcaggccgggggctgacctggaaatgaggccccggcggcgcggcgccaactgttttcaaacagtggcggacaaacagggcttggggctggcccgcacgctgcctgatcgtttccgcccgccgctccacctccccgcgggccccgcaccccgagacctcagcgcaccccatcgccttgcttgccagggtctccgaaagcgctgctggcccctcttcgcggccacccggcggcctctttccgccctctgaaccggcagttagctggcagcctcaaggcccggcgcccagggactcaaaggaccctcccgcgccccgcgaggctccggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 277424 - DNA, 984 bp, Homo sapiens
ctggttgaatacctccctctccactcccatcttcaggccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 277425 - DNA, 830 bp, Homo sapiens
cgcggcgcgcgacgcgagagacgacgaggaacaacagaacttagctaatgctgagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 277426 - DNA, 1111 bp, Homo sapiens
aaaagcagctgtaccgtccgaatccggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 277427 - DNA, 1914 bp, Homo sapiens
  misc_feature (186)..(186): n is a, c, g, or t
ggcaggagggaaaggttatgggtcggcccggcggtctctcccagcacccgcgactctcaccttgctcagctgctggtggatgagctgcttcagctcggaggctttctccggaggcagcgacatgctggcagccggcgtctccccgccgcttctccccgcctcagatgccctaactgcgcggccccngccgggccagggagcgttaggagcgactgagcacaaagcgccgcagccgttcgcctagcgcagctcccgggggacgcaacgccgcgtcaggccgggggctgacctggaaatgaggccccggcggcgcggcgccaactgttttcaaacagtggcggacaaacagggcttggggctggcccgcacgctgcctgatcgtttccgcccgccgctccacctccccgcgggccccgcaccccgagacctcagcgcaccccatcgccttgcttgccagggtctccgaaagcgctgctggcccctcttcgcggccacccggcggcctctttccgccctctgaaccggcagttagctggcagcctcaaggcccggcgcccagggactcaaaggaccctcccgcgccccgcgaggctccggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaaaaaaaaaaaagaaacaacacaaacactaaacataaacaacacaatatctaccccacatcacacccaacccacaccacacccatactccacttacaacacaaatactccacactaataccaacacccacgactcatccacacccgcccacctcacctcccacccccctcttcgcgccccaccacctcttcctactcacccccaccacccacagaccctgggaaacacaagctta

SEQ ID NO: 277428 - DNA, 1595 bp, Homo sapiens
  misc_feature (186)..(186): n is a, c, g, or t
ggcaggagggaaaggttatgggtcggcccggcggtctctcccagcacccgcgactctcaccttgctcagctgctggtggatgagctgcttcagctcggaggctttctccggaggcagcgacatgctggcagccggcgtctccccgccgcttctccccgcctcagatgccctaactgcgcggccccngccgggccagggagcgttaggagcgactgagcacaaagcgccgcagccgttcgcctagcgcagctcccgggggacgcaacgccgcgtcaggccgggggctgacctggaaatgaggccccggcggcgcggcgccaactgttttcaaacagtggcggacaaacagggcttggggctggcccgcacgctgcctgatcgtttccgcccgccgctccacctccccgcgggccccgcaccccgagacctcagcgcaccccatcgccttgcttgccagggtctccgaaagcgctgctggcccctcttcgcggccacccggcggcctctttccgccctctgaaccggcagttagctggcagcctcaaggcccggcgcccagggactcaaaggaccctcccgcgccccgcgaggctccggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaaga

SEQ ID NO: 277429 - DNA, 1614 bp, Homo sapiens
  misc_feature (186)..(186): n is a, c, g, or t
ggcaggagggaaaggttatgggtcggcccggcggtctctcccagcacccgcgactctcaccttgctcagctgctggtggatgagctgcttcagctcggaggctttctccggaggcagcgacatgctggcagccggcgtctccccgccgcttctccccgcctcagatgccctaactgcgcggccccngccgggccagggagcgttaggagcgactgagcacaaagcgccgcagccgttcgcctagcgcagctcccgggggacgcaacgccgcgtcaggccgggggctgacctggaaatgaggccccggcggcgcggcgccaactgttttcaaacagtggcggacaaacagggcttggggctggcccgcacgctgcctgatcgtttccgcccgccgctccacctccccgcgggccccgcaccccgagacctcagcgcaccccatcgccttgcttgccagggtctccgaaagcgctgctggcccctcttcgcggccacccggcggcctctttccgccctctgaaccggcagttagctggcagcctcaaggcccggcgcccagggactcaaaggaccctcccgcgccccgcgaggctccggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattacctcgtgccgaattcggcacgagattttttatttttttaag

SEQ ID NO: 277430 - DNA, 2500 bp, Homo sapiens
  misc_feature (186)..(186): n is a, c, g, or t
ggcaggagggaaaggttatgggtcggcccggcggtctctcccagcacccgcgactctcaccttgctcagctgctggtggatgagctgcttcagctcggaggctttctccggaggcagcgacatgctggcagccggcgtctccccgccgcttctccccgcctcagatgccctaactgcgcggccccngccgggccagggagcgttaggagcgactgagcacaaagcgccgcagccgttcgcctagcgcagctcccgggggacgcaacgccgcgtcaggccgggggctgacctggaaatgaggccccggcggcgcggcgccaactgttttcaaacagtggcggacaaacagggcttggggctggcccgcacgctgcctgatcgtttccgcccgccgctccacctccccgcgggccccgcaccccgagacctcagcgcaccccatcgccttgcttgccagggtctccgaaagcgctgctggcccctcttcgcggccacccggcggcctctttccgccctctgaaccggcagttagctggcagcctcaaggcccggcgcccagggactcaaaggaccctcccgcgccccgcgaggctccggggtctcgggcttccgccttcttgctgccctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttgtaagttctattatagcttaagcctcttctttgtctggttgtattcattaactcgcactttatatactacctaagtagaccaagtaagtgaacgtttgtattaaatatagacatatctttacataaaatttagtttaagctgaacttttgaaaattagaggacagttaaccaacctattatttacagttttttcattaaagctgactttccaaaaaggaaaatccttagttcttcattgtacttactattcatgttagattaattatgccagacatagtcttgcaataataaacaagccttctgtggaattcaggaatttttttagggaagtaaaaagtattgctatgtgagcaatactgtagctattgaatatgtattacagttgatatttttctctattatgaaatgagagcattacacccagggaagtgagttagcctttaggcataacagaacactgagcataaggctgctttctaagatgggtaactagctttttaattcatgcttttgccaagaacaaattgatacaaatcacataatgctgattttttttttaatccctattctttttgaatgtgattttccctaataaacttcatctacagcctttctggcatatctttataatttggaacttaaagaaatttatcttcagttgacatgaagacaaagaaactttatttttccttaacaataaaacctggctataaaagtgccaaccaaaaggaacacaaaaggagagttttataattcactttaaaaggagatttgatggtaaagtttaaagattaaaatattttgttcttcaattacagagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 277431 - DNA, 1047 bp, Homo sapiens
ctgaggagctacagctattatgcaacagagccaggttcaagctctgagctgttttactccaaaggctgtggcaataagaactcctctgagaaatgtgtggccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 277432 - DNA, 739 bp, Homo sapiens
tattctctcaatggtgtgcaaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 277433 - DNA, 591 bp, Homo sapiens
tgatttcaaatctctgagactgaggtagaaatgggaaaaaccaaatatggtacagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 277434 - DNA, 465 bp, Homo sapiens
accctatgaaagaatactgattcttatttttatttcttgtagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaa

SEQ ID NO: 277435 - DNA, 3900 bp, Homo sapiens
gaggaaatgttatcgttccatataaaaccatcgaagggactgccagaggtggaggggaggattttgaggacacttgtggagagctcgaattccagaatgatgaaattgttaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggaaaatacctgtttgttctagccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctg

SEQ ID NO: 277436 - DNA, 1737 bp, Homo sapiens
cctcctgtccacctgccatcccctatgcaaacagtaagaataaccccattcaaaaagcacatcatcgttttccatttgcattaacatgtgtctcagtcccatgttgccgttgcttgggattgtctgtcagttttattttcaaaggcatccatggcttgcacaatcctgttccagtcatgactgaacatttgctccttcttcatgtgccgttcggaaatgttgttgtgatacctgttacacagtgcatggtgaaaaacaaataaaacaaaacaaagagtatctgtatatagtagagtatagtacatactgttctcccatttggcaatgttgattggacattgaagacataagtgagttttcttttcacctgagttgttacttttgtgctgttattgagtttgattaattactagggataaaaggagaaaatggattattgttcacggttctgcacattcatttctaagaagcaataactgtcatgtggggagaagttaaagctattgagaggatagcaggcaaactacaaagatcttcatggaaaattagccatgtggaacacatcagaggcctctaaaaatcacccattaattcaggaaggccaaggagaaaggccttatagagacgttgatatgttggatgtgcctaggctttcagagccaccctttccacaacacccctccctgcaaagtatttatttcacatctgcactgtctggcacagatggtagatagtgctggtttgttcattttatttttttacttaaaaggctattttgagccctgtttctttcactgtccagtctagtcctctttgattatatcagtagttgctgagtaagaaagaagccagggtgaccaacgggcctttaaaagtgtgtctcctctacttatgctgaaagagaaggcaattaaataagactagtacctcccaggaggattggactgggatatttttaaccctttaaaaagaatagctgtttctatgttaaaataccaaagaacatggataaacccaacattccaaagtagtgagtccactaatgagaaaaataatagaatgactttggtcacctctcggagacttctgtgtctataaggaatcccaggctggagacattcctagccctctgtattgattcaaaaatacttaataaattaaagctgttgagacttattttttcttctgtcactcagtaaccatgatccttcctcatttaataaacatttggtgactgaatgagtaattaaatgctggttacccacttaatgtgccaggtagtatgatactttctggggactaagccatgaacaaaacagtctagatccctgccctcagaagggttacagtttatgtgattactattttcatgagtaaaagtgaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccggcttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatcctta

SEQ ID NO: 277437 - DNA, 4095 bp, Homo sapiens
gcttcccacagaagatgggagcgacctcttcctgatcgggagctgtttaaaaggagggagtgcgccgtattttctactagcgtggaggaacggaggaagaatccattcacactccccaaaccaggggatgtcatggtctagaacacctatgctgaagtacaaggctgagcaagaaagatcactccactgcaactgagcaaagtgctgaaggagttgaaaggaagaagagaacatcggacgtggtttcacggaggaggaagcattttaatttattcagaaagagtgaaaaggattttgaaagcaaataaggctagccacttttgaaacatgtcaaagagccccagcttatttacgacaagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtttctagccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctg

SEQ ID NO: 277438 - DNA, 4071 bp, Homo sapiens
tccattccgccccctctttgttgcggaggcaaactgaggttcctggagtcagaatctatcagtcgtggtgactgccctggttgcactgtaagtatggggggacgtctccacgaaaaaaaactaactttctgccttgtgctctgcaggtccctccttctcccaccttccccaagtagctgctcctgacccccccacacaccttggcaaacgacaccagtggccgatagcaactggtgttttaaaaatactaatttggagccccatttgagacctacaacgggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtttctagccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctg

SEQ ID NO: 277439 - DNA, 4009 bp, Homo sapiens
gctggtaaatttagagaaggcatcatactgggatcttttttcacatccagcccatgcggactgagcagccaaagcttgacagaggtccctccttctcccaccttccccaagtagctgctcctgacccccccacacaccttggcaaacgacaccagtggccgatagcaactggtgttttaaaaatactaatttggagccccatttgagacctacaacgggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtttctagccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctg

SEQ ID NO: 277440 - DNA, 3820 bp, Homo sapiens
gctggtaaatttagagaaggcatcatactgggatcttttttcacatccagcccatgcggactgagcagccaaagcttgacagagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtttctagccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctg

SEQ ID NO: 277441 - DNA, 3823 bp, Homo sapiens
tccattccgccccctctttgttgcggaggcaaactgaggttcctggagtcagaatctatcagtcgtggtgactgccctggttgcacttaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtttctagccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctg

SEQ ID NO: 277442 - DNA, 3859 bp, Homo sapiens
gcttcccacagaagatgggagcgacctcttcctgatcgggagctgtttaaaaggagggagtgcgccgtattttctactagcgtggaggaacggaggaagaatccattcacactccccaaaccataggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtttctagccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctg

SEQ ID NO: 277443 - DNA, 4021 bp, Homo sapiens
gcttcccacagaagatgggagcgacctcttcctgatcgggagctgtttaaaaggagggagtgcgccgtattttctactagcgtggaggaacggaggaagaatccattcacactccccaaaccaggggatgtcatggtctagaacacctatgctgaagtacaaggctgagcaagaaagatcactccactgcaactgagcaaagtgctgaaggagttgaaaggaagaagagaacatcggacgtggtttcacggaggaggaagcattttaatttattcagaaagagtgaaaaggattttgaaagcaaataaggctagccacttttgaaacatgtcaaagagccccagcttatttacgacaagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctg

SEQ ID NO: 277444 - DNA, 4117 bp, Homo sapiens
  misc_feature (2300)..(2300): n is a, c, g, or t
  misc_feature (2302)..(2302): n is a, c, g, or t
  misc_feature (2304)..(2304): n is a, c, g, or t
  misc_feature (2310)..(2312): n is a, c, g, or t
  misc_feature (2314)..(2314): n is a, c, g, or t
gcttcccacagaagatgggagcgacctcttcctgatcgggagctgtttaaaaggagggagtgcgccgtattttctactagcgtggaggaacggaggaagaatccattcacactccccaaaccaggggatgtcatggtctagaacacctatgctgaagtacaaggctgagcaagaaagatcactccactgcaactgagcaaagtgctgaaggagttgaaaggaagaagagaacatcggacgtggtttcacggaggaggaagcattttaatttattcagaaagagtgaaaaggattttgaaagcaaataaggctagccacttttgaaacatgtcaaagagccccagcttatttacgacaagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtgtnanantaacannnanataccttctagccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctg

SEQ ID NO: 277445 - DNA, 1499 bp, Homo sapiens
gcttcccacagaagatgggagcgacctcttcctgatcgggagctgtttaaaaggagggagtgcgccgtattttctactagcgtggaggaacggaggaagaatccattcacactccccaaaccaggggatgtcatggtctagaacacctatgctgaagtacaaggctgagcaagaaagatcactccactgcaactgagcaaagtgctgaaggagttgaaaggaagaagagaacatcggacgtggtttcacggaggaggaagcattttaatttattcagaaagagtgaaaaggattttgaaagcaaataaggctagccacttttgaaacatgtcaaagagccccagcttatttacgacaagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtctataaggaatcccaggctggagacattcctagccctctgtattgattcaaaaatacttaataaattaaagctgttgagacttattttttcttctgtcactcagtaaccatgatccttcctcatttaataaacatttggtgactgaatgagtaattaaatgctggttacccacttaatgtgccaggtagtatgatactttctggggactaagccatgaacaaaacagtctagatccctgccctcagaagggttacagtttatgtgattactattttcatgagtaaaagtgaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccggcttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatcctta

SEQ ID NO: 277446 - DNA, 1676 bp, Homo sapiens
cctcctgtccacctgccatcccctatgcaaacagtaagaataaccccattcaaaaagcacatcatcgttttccatttgcattaacatgtgtctcagtcccatgttgccgttgcttgggattgtctgtcagttttattttcaaaggcatccatggcttgcacaatcctgttccagtcatgactgaacatttgctccttcttcatgtgccgttcggaaatgttgttgtgatacctgttacacagtgcatggtgaaaaacaaataaaacaaaacaaagagtatctgtatatagtagagtatagtacatactgttctcccatttggcaatgttgattggacattgaagacataagtgagttttcttttcacctgagttgttacttttgtgctgttattgagtttgattaattactagggataaaaggagaaaatggattattgttcacggttctgcacattcatttctaagaagcaataactgtcatgtggggagaagttaaagctattgagaggatagcaggcaaactacaaagatcttcatggaaaattagccatgtggaacacatcagaggcctctaaaaatcacccattaattcagagccaccctttccacaacacccctccctgcaaagtatttatttcacatctgcactgtctggcacagatggtagatagtgctggtttgttcattttatttttttacttaaaaggctattttgagccctgtttctttcactgtccagtctagtcctctttgattatatcagtagttgctgagtaagaaagaagccagggtgaccaacgggcctttaaaagtgtgtctcctctacttatgctgaaagagaaggcaattaaataagactagtacctcccaggaggattggactgggatatttttaaccctttaaaaagaatagctgtttctatgttaaaataccaaagaacatggataaacccaacattccaaagtagtgagtccactaatgagaaaaataatagaatgactttggtcacctctcggagacttctgtgtctataaggaatcccaggctggagacattcctagccctctgtattgattcaaaaatacttaataaattaaagctgttgagacttattttttcttctgtcactcagtaaccatgatccttcctcatttaataaacatttggtgactgaatgagtaattaaatgctggttacccacttaatgtgccaggtagtatgatactttctggggactaagccatgaacaaaacagtctagatccctgccctcagaagggttacagtttatgtgattactattttcatgagtaaaagtgaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccggcttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatcctta

SEQ ID NO: 277447 - DNA, 3146 bp, Homo sapiens
gcttcccacagaagatgggagcgacctcttcctgatcgggagctgtttaaaaggagggagtgcgccgtattttctactagcgtggaggaacggaggaagaatccattcacactccccaaaccaggggatgtcatggtctagaacacctatgctgaagtacaaggctgagcaagaaagatcactccactgcaactgagcaaagtgctgaaggagttgaaaggaagaagagaacatcggacgtggtttcacggaggaggaagcattttaatttattcagaaagagtgaaaaggattttgaaagcaaataaggctagccacttttgaaacatgtcaaagagccccagcttatttacgacaagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctg

SEQ ID NO: 277448 - DNA, 435 bp, Homo sapiens
gcggccgctggcgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgtgagtacgggcctgaggcgggctcccagggcggttcccggggggactgccggcagcccggcgctcggaggggcctgggggtgggcggcgccggtcagggtgacagttgtcgggggagaagtgtggtcgaggacgagtaaaatgg

SEQ ID NO: 277449 - DNA, 5529 bp, Homo sapiens
cttgttatgaactataaaccagtaaatcttatattagctgcttcatagacattgctgatatttgtttatcatgaaatggtttttctagatactaacttgtagtttcttggggagatacaaaatgattctgcacaaaaagcagtttttactaacttgtaatcagagaatactctttggaggaatttaaattggagttttgtaaagaaaaacttagatggctttcttaatttttcttaaaggatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattcccttgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaaattg

SEQ ID NO: 277450 - DNA, 4557 bp, Homo sapiens
gcggccgctggcgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccccaaaagggggatcctatagatctcgccccgcaggcaccaggctgg

SEQ ID NO: 277451 - DNA, 5526 bp, Homo sapiens
gcggccgctggcgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcaggtaaactcttgagtggaaacagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattcccttgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaaattg

SEQ ID NO: 277452 - DNA, 2245 bp, Homo sapiens
taattatggcataggcagtatctcttaaagcacaggctctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattcccttgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaaattg

SEQ ID NO: 277453 - DNA, 2054 bp, Homo sapiens
gcggccgctggcgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacaggtaaaacttgcttgatggcacttcaacgtttcttcctatttcctgagtggtattgatgtgtgagagatagaatgttaaatggtgaaagaaactttataagctagtagttcctttttttggtagtagaaccccagtatatagtacaaaaataaaaaatgtggatggttgcagtggctcatacctgtattcctggcactttgggaggccaaggcaggcagatcacttgaggtcaagagtttgagaccagcctggccaacatggtgaaatcctgtctctactaaaaaaaaaa

SEQ ID NO: 277454 - DNA, 982 bp, Homo sapiens
gcggccgctggcgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaagtaaatatattcttccattaagggaatgatttaatatccagtttaatttttttatagtacctaatccatttttcattaaatatctactttttccagcatttatttgatcagtcattagttactgctggaaatgtaagagtttatggctgtaaatatcttaattttaaacaagattggaggatccaacttaatttttttaataaatagattccaaatgttaatgg

SEQ ID NO: 277455 - DNA, 599 bp, Homo sapiens
actttatatgttactcctgggaggttaaacattgtttcagactaatagaactagcattattaacgtgctgactctaactgaatttgttttgttctctctctactaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtaatttatgtggggcggtatcattatactttcaaaaagagttgtttctaccacaataatcataacttattgaaaaaattcaaatgctgtagaagtgaataaaaggataagttttcttatcaaatataccattggtaactatttggtatatgtgctcattgggcaagatggtatatgtatatgtgtatgtatatattaaggatacataaattttttctcttgaaaaatggtattatatgccgggtgcagtggctcacgcctgtaatcccagcactttgggaggccgaggtgggtggatcatgaggtc

SEQ ID NO: 277456 - DNA, 446 bp, Homo sapiens
cttctcacagtatgctctattcttgtttctgtattttaatcatacaaaatactgtggtttctcactatttatcctttcatatatcagggtttttcactctttgaatttcagaaaatggttgaatgttctttcatcatttttctttaaatttcttgaagctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactcta

SEQ ID NO: 277457 - DNA, 3359 bp, Homo sapiens
gcggccgctggcgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtaatttatgtggggcggtatcattatactttcaaaaagagttgtttctaccacaataatcataacttattgaaaaaattcaaatgctgtagaagtgaataaaaggataagttttcttatcaaatataccattggtaactatttggtatatgtgctcattgggcaagatggtatatgtatatgtgtatgtatatattaaggatacataaattttttctcttgaaaaatggtattatatgccgggtgcagtggctcacgcctgtaatcccagcactttgggaggccgaggtgggtggatcatgaggtcaggagattgagaccatcctggctagcagggtgaaaccctgtccctactaaaaatacaaaaaaaattagctggacgtggtggctggcgcctgcagtcccagctactcgggagactgaagcaggagaatggcatgaaccctggaggcagagcttgcagtgagccgagtgagccactgcactccagcctgggcgacagagcgagactctgtctcaaaa

SEQ ID NO: 277458 - DNA, 5580 bp, Homo sapiens
gcggccgctggcgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattcccttgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaaattg

SEQ ID NO: 277459 - DNA, 4924 bp, Homo sapiens
gcggccgctggcgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattcccttgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatt

SEQ ID NO: 277460 - DNA, 2670 bp, Homo sapiens
aggaaagaatataggctgtactggagaatacagctgcccaagaataagaaacaattactggaggatacagctgcccaaggaatagaaacaaatacaaaacaaaaacagccttaaatcaagtgaaaggttttatgttaaatatattatcataatctcttacgtatttattctctatctcctatattgcctggcatcgaaacttgactcacatgttatgtttagagttaattttgtgatttgatcatttgcttgaattttaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattcccttgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaaaacccagtgaattcaataccttaattagtacatactatcttatgtaatgcataaagcaatgccagtcactgagaacatttaaatatatttatattcctggagatacacattctcatttttgttggtttattataaattattcttctagatgcatcttttataactaggatttcattttgtgtgtatagcttatgtaataaattttaaaggtgaaaactctcttaaaattg

SEQ ID NO: 277461 - DNA, 4408 bp, Homo sapiens
gcggccgctggcgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatcggccggaggcggctccgctcggccggcgcggcgcagaagaaacccgcggcgaccacagccaaagcgggcgatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggcagttggccagacagcaggctgataaaaaaaaagaagagcacagagaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaacactgctgaagctgtacttcaaaaaatggatgacatgaagaagatgcgtagacagcgaatgagagaacttgaagacttgggagtgtttaatgaaacagaagaaagcaatcttaatatgtacacaagaggaaaacagaaagatattcaaagaactgatgaagaaacaactgataatcaagaaggcagtgtggagtcatctgaagagggtgaagaccaagaacatgaagatgatggtgaagatgaagatgatgaagatgatgatgatgatgacgatgatgatgatgatgatgatgatgaagatgatgaagatgaagaagatggagaagaagagaatcagaagcgatattatcttagacagagaaaagctactgtttactatcaggctccattggaaaaacctcgtcaccagagaaagcccaacatattttatagtggcccagcttctcctgcaagaccaagataccgattatcttccgcaggaccaagaagtccttactgtaaacgaatgaacaggcgaaggcatgcaatccacagtagtgactcgacttcatcttcctcctctgaagatgaacagcactttgagaggcggaggaaaaggagtcgtaatagggctatcaataggtgcctcccactaaattttcggaaagatgaattaaaaggcatttataaagatcgaatgaaaattggagcaagccttgccgatgttgatccaatgcaactagattcttcagtacgatttgatagtgttggtggcctgtctaatcatatagcagctctaaaagagatggtggtgtttccattactttatccagaagtctttgaaaaatttaaaattcaacccccaagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggcctatcagatgcgcccatcaattattttttttgacgaaattgatggtctggctccagtacggtcaagcaggcaagatcagattcacagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggctcgaaaagagattctaaagattcacaccagggattggaatcccaaaccactggacacatttttagaagagctagcagaaaactgtgttggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcagatatttcttgtcctctgctagaaagtgacttggcttacagtgatgatgatgttccatcagtttatgaaaatggactttctcagaaatcttctcataaggcaaaagacaattttaattttcttcatttgaatagaaatgcttgttaccaacctatgtcttttcgaccaagaatattgatagtaggagaaccaggatttgggcaaggttctcacttggcaccagctgtcattcatgctttggaaaagtttactgtatatacattagacattcctgttctttttggagttagtactacatcccctgaagaaacatgtgcccaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtgcaagaattgtttatccgtgattatggagagatttttaatgtccagttaccggataaagaagaacggacaaaattttttgaagatttaattctaaaacaagctgctaagcctcctatatcaaaaaagaaagcagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgtagctcctccaaatatgccccgtcttactaccatgtgatgccaaagcaaaattccactcttgttggtgataaaagatcagacccagagcagaatgaaaagctaaagacaccgagtactcctgtggcttgcagcactcctgctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaagaaatgtgtgttctgcgaatgactcgagctagacgttcccaggtagaacagcagcagctcatcactgttgaaaaggctttggcaattctttctcagcctacaccctcacttgttgtggatcatgagcgattaaaaaatcttttgaagactgttgttaaaaaaagtcaaaactacaacatatttcagttggaaaatttgtatgcagtaatcagccaatgtatttatcggcatcgcaaggaccatgataaaacatcacttattcagaaaatggagcaagaggtagaaaacttcagttgttccagatgatgatgtcatggtatcgagtattctttatattcagttcctatttaagtcatttttgtcatgtccgcctaattgatgtagtatgaatcctgcctgcgacctatgaggtccgcctactt

SEQ ID NO: 277462 - DNA, 581 bp, Homo sapiens
gacacatcttctacctgacttcagcaccagcggctccgtcacaagcttcccattcacatatgtctcagctccttcacaaggctccagagtgaccaccactgaatggaggggcagaggaaggggaaagattagaccctggaggaagatgtccattcctacctttcccactgacattatccctggtggggcctgggctcctccagcaggcttgtagcccacccctctgcctcatgcatcttgcaaactgccacctgactcatcttctcaagccacagctgacatgtgacaagagaaagtcaacccaacccaaacatccatctagctgctcctcagtacaaatcactgagcctgccagtttctggggacgcgaagatgcacgaggcagctccctgtcctcgaggagcagtggccattgccgcagaggaaccctggtatcccaaaggcccaggctctgcagctccttagccagggatgctgaacaagtcaatttaacttctgtgatattctataagatgggataatgaagtctgaatgaagagtggttagaaggcccaaaaaagtaaaccataaaataacatgca

SEQ ID NO: 277463 - DNA, 232 bp, Homo sapiens
ctgttgcgaggaatgctgagcatgggagaacatagggaactaacggtactgaaggcccaaaaaagtaaaccataaaataacatgcaaacatgtgttttattattataatacttatactggaagtaatagagaaacacagaaactgggatgaactataatatcaggcagggatggggacaacggatgctgctgggagacaaggagagcagaggactcagcattcctcgcagag

SEQ ID NO: 277464 - DNA, 753 bp, Homo sapiens
tcagggtcctcctctaggatgcacccagaaggacctcccttgagacttcctacacacagccacgccccagaaccctcaatctgcgacacatcttctacctgacttcagcaccagcggctccgtcacaagcttcccattcacatatgtctcagctccttcacaaggctccagagtgaccaccactgaatggaggggcagaggaaggggaaagattagaccctggaggaaggtgggtcatggtcacagattcccaccttgccttaccccaaaaaaccacacatgcaccaccagtcccacccccagtacctgtagggggtgccatggcccctctggtggcaggcagcacgggaaaggaagagcagaaggagggttagagccccaactacaattcccagaagcctctgcagtggctcctgactcacccacctctatcctccccagcagcagcttagaaaaccagtaattgtcaaaaggattcattcctcatgtttaactgctcagaggccctgtcatttctgccttccagatgtccattcctacctttcccactgacattatccctggtggggcctgggctcctccagcaggcttgtagcccacccctctgcctcatgcatcttgcaaactgccacctgactcatcttctcaagccacagctgacatgtgacaagagaaagtcaacccaacccaaacatccatctagctgctcctcagtacaaatcactgagcctgccagtttctggggacgcgaag

SEQ ID NO: 277465 - DNA, 344 bp, Homo sapiens
tatgggtccctgctggagaagctgtagcatcgggccgctcaccatggcagccggctccatcaccgccagccagcgagagggcaagacaagagggctgacgagggacgctaccatcacagagaaacagggtttcattgtgttagccaggatggtctcgatctcctgacctcgtgatccaccgcgcccggccaagtctgaacttttgcatggcctgttgccctggtgataaactgatgccttgtttcctaaaaggaataaagccatgagttgcctttgttcagctcatgggcattcacccatgcacagaggaaaaataaaatctacgactcgggtaaaaaaaaatc

SEQ ID NO: 277466 - DNA, 333 bp, Homo sapiens
agtgaacaggtagcatcaggtgtgccatttcagtgactgggcacagcccaggcacccacatctctctgcacaccaccatgcccagctaattttttgtatttttttagtagaaacagggtttcattgtgttagccaggatggtctcgatctcctgacctcgtgatccaccgcgcccggccaagtctgaacttttgcatggcctgttgccctggtgataaactgatgccttgtttcctaaaaggaataaagccatgagttgcctttgttcagctcatgggcattcacccatgcacagaggaaaaataaaatctacgactcgggtaaaaaaaaatc

SEQ ID NO: 277467 - DNA, 1257 bp, Homo sapiens
taacatatttgtacacagtgttcatagcagctttattcacaatagccaaaaggtgaaaccacccacatgtccatcaacaacaatggataaacaacatgtggtatatacacacaaggtaatatcaaccagccttaactaaaagaataaaaatcagccaggcacagtatatggggccagcccctgtgccaccgaagaggggggatattgaaaacatgttacagccaggagcggtgcccccttggtatttacaccctggagtggtccgctcctcttgggctgaacctgtaacttgctcccaagcaagagcacacagcaagctcacgcacgtggttgttggtgtgattctgtttctccagattgtctccattcctccctggcttctccacagggccgctcaccatggcagccggctccatcaccgccagccagcgagagggcaagacaagagggctgacgagggacgctaccatcacagaggtcagttttgtaacctaaccacaagactaacctactgtcacttctgccctatcctactgctagaagccagtcgctacatctcccccacactcaaagggaggtggtcgcactgtggggtccactggaagttgcctaccagactcaggtcatcccaaacacaccctctagccatttggtgtggcatcggaaagaaaactaaggccaggtacggtggctcatgcctgtaatcccaacaatttgggaggccatggcggaagggtcacttgagcccaggagtttgagaccagcctgggcaacatagcaaatgttatgttgccacctctacaaataattagccaagtgtggtggcatgcacctgtagtcccagatactcaggaggctgaggcaggagaatcacaggtcgaggttgtagtgagctgtgacggcactgcactccagccttggcaacacagtaagacctcgtctctaaaaaagcaaaaagggctgggtgcactggctcacacctataatcccagcacaccaccatgcccagctaattttttgtatttttttagtagaaacagggtttcattgtgttagccaggatggtctcgatctcctgacctcgtgatccaccgcgcccggccaagtctgaacttttgcatggcctgttgccctggtgataaactgatgccttgtttcctaaaaggaataaagccatgagttgcctttgttcagctcatgggcattcacccatgcacagaggaaaaataaaatctacgactcgggtaaaaaaaaatc

SEQ ID NO: 277468 - DNA, 388 bp, Homo sapiens
ccagtggcttgagagttgggagctgaagggcctggtctcttgggaggtgtccctggcacaggctgatttgaatctctaactgaatggaaatcctcccagtccaagagtatacctcccactccctccccacggtttttgcttagcggtatgacctccagagaatttctgatttcctcctgtgatgtggctgtcagcccctttcttcactcccctgtgctgtgccccaggaggctccatggacctctgttttggtcccagcttctctgggaaacaggcaacgtgttgtcggctgggctgtggccgggcatctgctaactcaggcagactctgctgcaacctctgcccggcgtgtctttctgcagagcggggatgatgaggagtaccagcg

SEQ ID NO: 277469 - DNA, 1318 bp, Homo sapiens
gagccccggcccggaggtctgtcatgctgttcccgctccaggtggccgctgtaacctcttcggtccgcgacgatcctctagagcactgtgtgtctccccggacgcgagcccgctcccctgaaatctgcaaaatggctgataatttggatgaatttattgaagagcaaaaagccagattggccgaagacaaagcagagttggaaagtgatccaccttacatggaaatgaagggaaagttgtcagcgaagctttctgaaaacagtaagatactgatctctatggctaaggaaaacataccaccaaatagtcaacagaccaggggttccttaggaattgattatggattaagtttaccacttggagaagactatgaacggaagaaacataaattaaaagaagaattgcggcaagattacagacgttatcttactcaggaaaggttgaaacttgaacgtaacaaagaatacaatcagtttctcaggggtaaggaagaatccagtgaaaagttcaggcaggtggaaaagagtactgagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgttttgatagacggtatcatagaccagaccaagatcctgaagtaagtgaagaaatggatgagaggtttagatatgaaagtgattttgatagaagactttcgagagtgtatacaaatgacggattgcccttcgcctcactccctatacactttggtactaatatcgaactccttatgatgatgcatactattttatgggtcaggaataactttcgatcccagtcttgctattatggtcaggaatgatggcgtaagctggaactatgtaatgtctgttaccacaataaaaaactgtgggatacgtggcgaagaccgagatacacggaacgaaacaggggatttgagagaacgcacctctaagttcttcaaagttcgactccacacaaacagcaaccacacatactacagaaccccgagggccgcaaaattggcaacacgcaagggatacagttggagttggcaaaaggg

SEQ ID NO: 277470 - DNA, 1417 bp, Homo sapiens
gagccccggcccggaggtctgtcatgctgttcccgctccaggtggccgctgtaacctcttcggtccgcgacgatcctctagagcactgtgtgtctccccggacgcgagcccgctcccctgaaatctgcaaaatggctgataatttggatgaatttattgaagagcaaaaagccagattggccgaagacaaagcagagttggaaagtgatccaccttacatggaaatgaagggaaagttgtcagcgaagctttctgaaaacagtaagatactgatctctatggctaaggaaaacataccaccaaatagtcaacagaccaggggttccttaggaattgattatggattaagtttaccacttggagaagactatgaacggaagaaacataaattaaaagaagaattgcggcaagattacagacgttatcttactcagtaatgtgtatatatacagaaaaattttctatctacgagtgaaacagatccatctactttgggagtttctcttcctattggtgagaggttatctgctaaggaaaggttgaaacttgaacgtaacaaagaatacaatcagtttctcaggggtaaggaagaatccagtgaaaagttcaggcaggtggaaaagagtactgagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgttttgatagacggtatcatagaccagaccaagatcctgaagtaagtgaagaaatggatgagaggtttagatatgaaagtgattttgatagaagactttcgagagtgtatacaaatgacggattgcccttcgcctcactccctatacactttggtactaatatcgaactccttatgatgatgcatactattttatgggtcaggaataactttcgatcccagtcttgctattatggtcaggaatgatggcgtaagctggaactatgtaatgtctgttaccacaataaaaaactgtgggatacgtggcgaagaccgagatacacggaacgaaacaggggatttgagagaacgcacctctaagttcttcaaagttcgactccacacaaacagcaaccacacatactacagaaccccgagggccgcaaaattggcaacacgcaagggatacagttggagttggcaaaaggg

SEQ ID NO: 277471 - DNA, 1399 bp, Homo sapiens
gagccccggcccggaggtctgtcatgctgttcccgctccaggtggccgctgtaacctcttcggtccgcgacgatcctctagagcactgtgtgtctccccggacgcgagcccgctcccctgaaatctgcaaaatggctgataatttggatgaatttattgaagagcaaaaagccagattggccgaagacaaagcagagttggaaagtgatccaccttacatggaaatgaagggaaagttgtcagcgaagctttctgaaaacagtaagatactgatctctatggctaaggaaaacataccaccaaatagtcaacagaccaggggttccttaggaattgattatggattaagtttaccacttggagaagactatgaacggaagaaacataaattaaaagaagaattgcggcaagattacagacgttatcttactcagaaaaattttctatctacgagtgaaacagatccatctactttgggagtttctcttcctattggtgagaggttatctgctaaggaaaggttgaaacttgaacgtaacaaagaatacaatcagtttctcaggggtaaggaagaatccagtgaaaagttcaggcaggtggaaaagagtactgagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgttttgatagacggtatcatagaccagaccaagatcctgaagtaagtgaagaaatggatgagaggtttagatatgaaagtgattttgatagaagactttcgagagtgtatacaaatgacggattgcccttcgcctcactccctatacactttggtactaatatcgaactccttatgatgatgcatactattttatgggtcaggaataactttcgatcccagtcttgctattatggtcaggaatgatggcgtaagctggaactatgtaatgtctgttaccacaataaaaaactgtgggatacgtggcgaagaccgagatacacggaacgaaacaggggatttgagagaacgcacctctaagttcttcaaagttcgactccacacaaacagcaaccacacatactacagaaccccgagggccgcaaaattggcaacacgcaagggatacagttggagttggcaaaaggg

SEQ ID NO: 277472 - DNA, 8791 bp, Homo sapiens
ggcacgaggtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaaacaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaatatatatatatatatatatatacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactatttt

SEQ ID NO: 277473 - DNA, 7990 bp, Homo sapiens
tgtttcccggttcgacactagcaggattcctcaagatagaatatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaatatatatatatatatatatatacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactatttt

SEQ ID NO: 277474 - DNA, 6390 bp, Homo sapiens
tagaggatcccgtgtcatcccccttcgtagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaatatatatatatatatatatatacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactatttt

SEQ ID NO: 277475 - DNA, 3725 bp, Homo sapiens
tgactcagggcgagctgcagctcgcctctgacgttatctcacgggagcgagctgcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaatatatatatatatatatatatacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactatttt

SEQ ID NO: 277476 - DNA, 4304 bp, Homo sapiens
ggcacgaggtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaaacaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagagagtcgccctgtcgtcggaccggctcatgt

SEQ ID NO: 277477 - DNA, 3113 bp, Homo sapiens
ggcacgaggtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaaacaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatgattcagaagataaacgggccgg

SEQ ID NO: 277478 - DNA, 7131 bp, Homo sapiens
ggcacgaggtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaaacaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacccccgaaaccagacgagctacctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagagagaggggcgcgcgcgccccaaaactctctccccggggggggcccacacacagagagaacccaccccttgttttttataaaaggggggcgacaaaaaaagaggggcgttattataatacagagagaagagagagggtctctcataaaaaacagtgtaggtgaagagacacacaaacagaagcagagaagaacaatacgagacgcagcacaccaacaaacacacgtgagatgaacaaatcaacgaaaacaacaccacacaacaaaacacactccccaccggaaaaacaaacccctacacacccctatactttatcttcaacaaacaccaacccacacactctcctcccgtcacaaacaacatcccctccaaaccatatacatctcacacaacattatacacacacacaacaaaaacaccacacccacctagtagaccgagtatagaaggaacacccacgcaaccaccagcaccccaaggagcccgccagaggcaccggcacgcaacccgaccagagccggaagggaacgacggcgaaataggcgagaggacaaagcacaggaacaaaaaaaaaacaaccatacagacaccaaatcaaaacaaacaacaagaaaccacaagaagaagagaaaagagcaagaagaacaaagcaaacaccaaaagagaagaaaaagagggaacaatagacaacacaagcagaaaaacgcgcgaagcacctacacgaacagacactcagagcacagatcaacaaaacagaacgcagaacc

SEQ ID NO: 277479 - DNA, 2218 bp, Homo sapiens
ggcacgaggtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaaacaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcaggtaaagttggatattcaggttagacaatcaagcaacttgttcatggctgagaaacagcagattaattacattgtgggttaagcagtaacagcagtttgcctaatctcagaatagttgtggttatgtgtgtatatgtagttctgctgtttataatattcctttcaaacccatgataactgctttggttttgcagataagcacatggctttgactatcaatattaaataagcttggtttattttttgtcttactgtatgaagaagaatttgggatttgaccaaaaacaaacaaaaaacaagcttctcatgagtgataaaacacctatatttattaattcaagaag

SEQ ID NO: 277480 - DNA, 1320 bp, Homo sapiens
ctcagaatggaggtgtccccggctgcccttccagatggcaccaagtccagccacaggtcagctacacacatagcacactgggacaatgctgggctccattcagggtattttattttcttaaagtagacaacctttgactttcatccaatccccagcttctctttcccccgtacatctcttcacgtccttggctgtgattccgcacactgacctcggacacacagctactgcacggagagagggagggagatctggcaagggctccggcagtgcctctcctctccatggcgcagttcgtatttacacacggcccttggcgaacgtcctttcaacgcagttgcccataggccctgggacaggaaggcccagatcagggtcccagcagggcctccctcaggccacaacgctggctgtgccttcacaggagtcagagcatttccagccagtctcaggcgcggggcatgctgggaccaggggcaccaccccttgctccccttccttcactcagcaaagccacaaataatttactctttaaataccaagacacttagctattgttcatttgctcccaggtgaaagaaccttctttaaatatgtcgtgtttattttcttaaataaaaacaaagcagaaaaccccaccattaacaagaggacactgcagaggcttatgtacaacacgtgtcccgcgaggctggcgcaggactgccactcactccaaaatttctttggagcagagagacagatcgtccagataacaacttttacactcagcaagccagacacaaaaaagaccacctgaaaaaaaatatgttttgaaaatctgcatttaaaaaagaatactcaactgcatttgaaattttctggatttttttctgcgaaacaccacgagatttggccaaaaaaaaaaaaaaaccaaaaaacaaaacaaaaaaaaaatgtcagagaaggaaaaccaggttttgatttataaaacatcagactagtagaagaaaagctggaatcccagctggcctagtttgaaataaatcgtgccactcgttttgttgtattggtttttgctgcatattttgaagctgttttttaaaaagagctgtgagtggctggaggtctggttagtgctgtcacccggctcctaaggtcccaggtccagaatgaaagtggtgctgagcagctgtgtgcaggccagcagggaaggtgcacagaccctgcactggtcctccctcttggtcagcggcaaggtccctaggccagagctcgggcagcgagctggccctcctccaggcgacaggggtgcagttggcctaccttgcctcagccctg

SEQ ID NO: 277481 - DNA, 790 bp, Homo sapiens
ggcgccgcggacgctgctggagtcgcctggcaacgatgtcgcctggcaactgaataggttggccagtggcgcgggctactggaagcagaaagggctgcggaggcagtgagtggtttctgcagagcttcatttggaaaggcctctgtagttggggaaagatggcccattcccagaactccttggagcttcccattaacatcaatgccacccagattaccactgcctatggccatcgggccctgcccaagctgaaggaggagctgcagtcagaggacctccagacgaggcagaaagccctcatggccctgtgtgacctcatgcatgaccccgagtgtatctacaaggccatgaacataggctgtatggagaacctgaaagctttgctgaaggatagcaacagtatggtgcgcataaagaccaccgaggtgctccacatcacggcaagccatagcgtgggcagtagtgacaggaagggggaatgaggatagcagccctgggcttggcatcttgtcaccttgaggagttaatttgcatgacatcccacggacaagagagcttcctggcagcctgttccctgccctcttgcttgcctctggtgaggaggcacacaggcaaacacaactgactatcaaagcatgagagacatggagtgggtgactagacacggaccaaggaagcccccgtggtcagggaagacccctgcaacttgtgtgtccaacggtgactttctttttccagacgattcaaaacacaccataagtgaaaataaataaataaataaaataaataa

SEQ ID NO: 277482 - DNA, 1252 bp, Homo sapiens
ggcgccgcggacgctgctggagtcgcctggcaacgatgtcgcctggcaactgaataggttggccagtggcgcgggctactggaagcagaaagggctgcggaggcagtgagtggtttctgcagagcttcatttggaaaggcctctgtagttggggaaagatggcccattcccagaactccttggagcttcccattaacatcaatgccacccagattaccactgcctatggccatcgggccctgcccaagctgaaggaggagctgcagtcagaggacctccagacgaggcagaaagccctcatggccctgtgtgacctcatgcatgaccccgagtgtatctacaaggccatgaacataggctgtatggagaacctgaaagctttgctgaaggatagcaacagtatggtgcgcataaagaccaccgaggtgctccacatcacggcaagccatagcgtgggcagatacgcctttctagagcacgacatcgtccttgccctgtccttcctgctgaatgaccccagcccagtctgccgggggaacctgtacaaggcatacatgcagctggtccaggtgcctagaggggcccaagagatcatcagcaaaggtctgatttcctcactggtatggaagctgcaggtggaggtggaggaggaggagttccaggagttcatcctggacacactggtcctctgcctgcaggaggatgccaccgaggccctgggcagcaatgtggtgcttgtcctgaagcagaagctcctcagcgccaaccagaacatccgcagcaaggccgcccgtgcgctccttaatgtcagcatatctcgagagggcaagaaacaggtgtgtcattttgacgtcatccccatcctggtccatctgctgaaagacccagtggagcatgtgaagtctaacgctgccggtgccctgatgttcgccacagtgatcactgaagggaagtatgcggccctggaggcacaagccatcggcctgctcctggagctgctgcactcccccatgaccatagcgcgcctgaatgccaccaaggcccttaccatgctggcagaggcccccgagggccgcaaggccctgcagacgcacgtgcccactttccgtgccatggaggtggagacttacgaaaagcctcaagtggccgaagccttacagcgggcagcccggatcgccatcagtgtcatcgagttcaaaccctgagcccttcattcacctctgtgagtgaataaatgtgctaagtctcttta

SEQ ID NO: 277483 - DNA, 1273 bp, Homo sapiens
ggcgccgcggacgctgctggagtcgcctggcaacgatgtcgcctggcaactgaataggttggccagtggcgcgggctactggaagcagaaagggctgcggaggcagtgagtggtttctgcagagcttcatttggaaaggcctctgtagttggggaaagatggcccattcccagaactccttggagcttcccattaacatcaatgccacccagattaccactgcctatggccatcgggccctgcccaagctgaaggaggagctgcagtcagaggacctccagacgaggcagaaagccctcatggccctgtgtgacctcatgcatgaccccgagtgtatctacaaggccatgaacataggctgtatggagaacctgaaagctttgctgaaggatagcaacagtatggtgcgcataaagaccaccgaggtgctccacatcacggcaagccatagcgtgggcagatacgcctttctagagcacgacatcgtccttgccctgtccttcctgctgaatgaccccagcccagtctgccgggggaacctgtacaaggcatacatgcagctggtccaggtgcctagagcagaaaaccccaccattaacaagaggacactgcagaggcttatgtacaacacgtgtcccgcgaggctggcgcaggactgccactcactccaaaatttctttggagcagagagacagatcgtccagataacaacttttacactcagcaagccagacacaaaaaagaccacctgaaaaaaaatatgttttgaaaatctgcatttaaaaaagaatactcaactgcatttgaaattttctggatttttttctgcgaaacaccacgagatttggccaaaaaaaaaaaaaaaccaaaaaacaaaacaaaaaaaaaatgtcagagaaggaaaaccaggttttgatttataaaacatcagactagtagaagaaaagctggaatcccagctggcctagtttgaaataaatcgtgccactcgttttgttgtattggtttttgctgcatattttgaagctgttttttaaaaagagctgtgagtggctggaggtctggttagtgctgtcacccggctcctaaggtcccaggtccagaatgaaagtggtgctgagcagctgtgtgcaggccagcagggaaggtgcacagaccctgcactggtcctccctcttggtcagcggcaaggtccctaggccagagctcgggcagcgagctggccctcctccaggcgacaggggtgcagttggcctaccttgcctcagccctg

SEQ ID NO: 277484 - DNA, 1971 bp, Homo sapiens
gggattccaactcgggactccccgcttctggggagaccggtgaggcccccgcgacatggccctcccatccccaagcctctcgtgcagatctccgctctgtgggacttgattgcgggctgcgggcccgtggctcctgcaggcagagagaggacgggagaggagacggctacgaggcttggccgcaggtagctacggtgctcccccaacaaggaaccggaaaccctcttcgtttgttgatctaaatatacaaaaataaaactagttgctgggttctcagacggagtctctgcggcattaggaggcccacccttattttctcttttcttcacgcaggaatcaggtccctggcctgggggcggcaaaaggagatggcggtgggtcaagtgggcgcgcaggctcagacctggggcttctgagcccacgcccaggcatctcggacctctcacttctgaggccacctcctgccctttagaatgaagggctggcacagttctgccaggatgcacgtttagcgacttctgtcagactgaagcatcccctctccgcaagcgcctgaagtgtgagaggcactgttctaagtgctttaatttgcacttgtttaatcctcacaggagtcaacttgaatgggcacacttattcccactttacagaagaggaaactggggcacagaaagactgagtaattgctcagggggcatgctccaagaaagagggagagacaggatttggacccagacaggctggctccctagtgctctggactttggtgtggatgatccaactcaagccttctcctttttccctcctatgtgatcttgcatgcgtttgtgcagagaatgagaaggcagatcaaagttacagatgctgcgagaacatcgccaagcagaatcttgggtgctgtccccacctctctgtacctgctccctcccagagaagccagcctccacttgctgtcccgggccttctctatctgagaaaagttgaaggagcacatgtccttgcgcaggaagaggctgttcagcgtgaccgccccgatcaagaagaagagctgcttcaccgcctgcctcacaagctcggggtccaggccgttctggcacatggtggtgtaaaagtagctcagctgttgcaggacggaggtcatggtgtagccgtccgtgtcgtctatgctagaggagcgcttccggaagcctgtgggcttcaggccggaaatgccctgcaggctctcatactccagcattcccggaactgcggagagacagggaggctgtgctgacacgccaggagacacacgcggaacgttcccgacgctcttcggtttgtttcaggagatgggacatttttctacaagagtcagtggatgtacttatgatagagaaagcaaaagaatcaagggtttgggacaccagggtgtgtgtcagggttagggatggacggctgtttccagcggggctgcagctcctcttgtaggtttgaagcagcacgtttttcagcttcacaggaaagaaagctgcttagcatgacaaatcatggcctgggcattaaagcctaaagtatttaaatttcaggaaattaaggaaagtatacaagaattcgaatggggctttaggatttcaaaaatacttggctacgccaagaagtagaagtaccacataaatagcagtagtagaagtttccccaagttttttccttcaggataaatcatccttatataaagaaaactaccaacagcgtactattatttatggaatcattataagcaagcaaagaattaaaaggcagatatctacatgattatatttccttggctttttaaacaatgttacacataatcacacattacacataccaagtttatgttttaaaaagtcttaatgttactataaatattttttggtcatccattctcttcttacctattatcggttggatattcttttccattatgataataaattgatgatatattcgtat

SEQ ID NO: 277485 - DNA, 421 bp, Homo sapiens
gaatcctccagtgagtaaggcaagtatcactctgggctcccatggcctctgggttcctgtggcaccctctgtcctggcattatattgaaatgtgattatatagaaatgtgactgcattatattgaaattacttatttaacacatgtctaaatattgcttactctatgctaggcactgttctaagtgctctactaatatttaaccctaataacaattatttgagataagtactattattatccccagttctaggtgaggaagctggggcacagtgaagtcagtactttgttcagcgttacacagttcataatggtggagctgaggtctgaactaaggctgtagagctccaggatctgtgtgccttttacactgtgggtatccctcccccgctggctagccagttcctcaagggcaggggcca

SEQ ID NO: 277486 - DNA, 494 bp, Homo sapiens
gctttcatgtttgaagaagagtttattgtgacttcaaacataagctgtaactggtaataagcgacagctatggaattatacaaggcaatccaatcaaacaacatggagcacactgaagcgcaaacatcaaattttacctttttcctcctaaaaactttattccctaattacatccattactttctttctttgtttctttctttttttttttttcttttgagacagagtctggttctgtagcccaggctggagtgcggtggtgtgatctcagcccactgcaacctccacttcccgggttcaagcaattctcctacctcagcctccaaagtagctaggattacaggtgtgcaccaccacccctggctaatttttctatttttagtagaggcgaactttcaccatgttggccaggctggtgtctgtaatctcagctactcgggaggctgaggcaggagaattgctggaacccgggaggcagaggtggcagtgagccg

SEQ ID NO: 277487 - DNA, 412 bp, Homo sapiens
ggcacgagggaggggaagaggcttagatattttctgtagtggaagaggtgtctcatcaaagtagtaggttcccaattagagcatcctcctaggcagtggtgcccattagcatgatttggtaggattctttttatttatttttttgctactgataacttagccatttgccttcttgtcttaactattagggtaattcacttttctttgggaggcactggaacatagcagttgagagattaaacgctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgtttta

SEQ ID NO: 277488 - DNA, 2182 bp, Homo sapiens
gttgagtcaatgtgtccccctcttgttcctagggtgcgggcttcatggccttctcctccaggaagctccacctgatcatgtcctgggtggatatccagcccccatagttcagggcctactagcagctgctagatcttgaactccaggagcgccccacgccttgggagcttggcatgggctaaatactcccccatttgttaaatggggtcctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagatcatccgtcaggtccaggccgtgttccccttcttcagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccgctcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgtttta

SEQ ID NO: 277489 - DNA, 1447 bp, Homo sapiens
gttgagtcaatgtgtccccctcttgttcctagggtgcgggcttcatggccttctcctccaggaagctccacctgatcatgtcctgggtggatatccagcccccatagttcagggcctactagcagctgctagatcttgaactccaggagcgccccacgccttgggagcttggcatgggctaaatactcccccatttgttaaatggggtcctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagatcatccgtcaggtccaggccgtgttccccttcttcagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgtttta

SEQ ID NO: 277490 - DNA, 663 bp, Homo sapiens
ggcacgagggaggggaagaggcttagatattttctgtagtggaagaggtgtctcatcaaagtagtaggttcccaattagagcatcctcctaggcagtggtgcccattagcatgatttggtaggattctttttatttatttttttgctactgataacttagccatttgccttcttgtcttaactattagggtaattcacttttctttgggaggcactggaacatagcagttgagagattaaacgctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaatgccatgcctgatttttgggtcaggagtggtgacttgggtaaccacttggcgggggggcctgggattccctgctgtgtgccgtgataacagcaaatggtgataaggagaaagccaagacctgtggcctgatgcagggctggcggccaggccggtcagctcggtccacagctctggcgcgggcaggtctgggcgccggcgaccccggggcttgcgggctctctagggagggggcaggggcgcccctgagga

SEQ ID NO: 277491 - DNA, 2433 bp, Homo sapiens
gttgagtcaatgtgtccccctcttgttcctagggtgcgggcttcatggccttctcctccaggaagctccacctgatcatgtcctgggtggatatccagcccccatagttcagggcctactagcagctgctagatcttgaactccaggagcgccccacgccttgggagcttggcatgggctaaatactcccccatttgttaaatggggtcctgaaacctgaccagggaagacgggataaagtagccatgggtcatcgcagcccctttgaagccgggcctggccacccaaaggcaactcaggggtggagactgaggcctcaggagaagcccccactagaatgctctctgcccctcccttccagattaaccaaaacctgctaattgtggaagccctcggcatgctcccctcccccacagcctcttcctcccttccctcccctcccccttccatccgaatgataaaggccccagcccgcctgccccagcccggcctcaggtcccggccctgccttctacactgccccaccgccctgcaccctccacccggccaggcccctgcccacgctgtctaccgtcccgcatggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagatcatccgtcaggtccaggccgtgttccccttcttcagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctgtgaggctcttaagacaggggccgctcctccctcccgctcccacccccaccttgttgacagggagccaaggcgaggcggctgtctgcgaccacagcagcctcgaaacaccaggcagcagccttgctgggagtccacggtgtttattgggccaccccacgcatggccgtggcccagctgggcacaaccctcaccctggtctgtcatgcctgtttttcctacactcagcggcaaagctgcaggagcagggctgagcctggaatagcccttcctagtcccctcttctcagcccactacccatccatcagtcaccagccgtcacctcccctcccgtgctccaggctgggggagggagagcccagtggtggatccagcctgaagtcctgccctctctcatctgtctggaaaggaggtagcacctttttcgggaaacgggttagggagtaaagactgcaccctacatggtcctggtggtgggggggataacagtaaaggaatttgcaacgttttaatgccatgcctgatttttgggtcaggagtggtgacttgggtaaccacttggcgggggggcctgggattccctgctgtgtgccgtgataacagcaaatggtgataaggagaaagccaagacctgtggcctgatgcagggctggcggccaggccggtcagctcggtccacagctctggcgcgggcaggtctgggcgccggcgaccccggggcttgcgggctctctagggagggggcaggggcgcccctgagga

SEQ ID NO: 277492 - DNA, 514 bp, Homo sapiens
aatgctcttcaccagggaggacacgaaggatccctcagccccactgagcacagacaccaggtttccagagggccgcttctggcaggccagctttgagggcaacaaagagaatgagagggagcctgagacctgctgagggagggcagggcaaagaaaagtgttcgctcatcctgctgagattcaaggagagtcacccctggctagaagctacaatcatccaagtgggaagtaatgtctaccgatgttctgatttaagtgaatgaaggtcttctttccacctcgggaaatcttgagggttatgtaacagcagctttgaaaggcttgtgagatgtactttgtgctagtccatctcaaatcttcaccggctgtaccaagaacagaaaaaaaaaggaatttggtgagtactttataaagctaaatttactcaattaatttcacctctgattatgtttttcatgtatcttgggacattagaatgtcctgtatttataaatgatgatgaggatagagagta

SEQ ID NO: 277493 - DNA, 487 bp, Homo sapiens
aactgttgaacctcctgtttggtggcatattattttgatttttggtgactttttcttggaataagtcaacaaatattaaccaagtgcctaccacatgccaagcgctgctctaggtatacagtggtgagcaaagttgggttgagtttttcaatagaaaatccatgtttgggtaatttaagcttaaaatatcatgcaaacaggctggatgcattggctcacacctgtaatcctagtactttgggaggccgaggcagacagatcacttgaggtcaggagttcaagactagcctggccaacatggcgaaacactgtctctactaaaaaaatacaaaaattagccggacgtggtggcgggcgcctgtaatcccagctacccgggaggctgagggatgagaatcgcttgaacccaggagtcggaggttgcagtgagccgagatcccgccactgcactccagtatgggcaacagaatgagactccatctcaaaa

SEQ ID NO: 277494 - DNA, 610 bp, Homo sapiens
ttccagtgattctcctgcctcagcctcctgagtagctgggattacaggcgccagccaccatgcccggctagtttttgtgtttttagtagagacgggatttcaccatgttgcccaggctggtctcaaactcctgatctcaggctcaagctaccttcttgatgaaaaattctggacgtgttctgaaaatcacagtcatccctaacttcagtggaaaagattcatattgtccagctgaacaaggattgatacttaaaaccagggatttcctaaaatgaaaatgtttctgtggataaaactgattacatgcagagactggaatggagttaattctgggtagatatgggattcaagagattggtcttcatgaggcatttatcaaggatctgcaagggatttagaggtgacggaagcacagtccttcctgggcagttgcctctagcctggtgggaggtgttcctcacacccaggactctcatccatggcaaaataaaaagtgagatatcgactgggcatggtggctcatgcctgtaatcccagcactttgggaggtcgaggcgggtggatcacctaggccaggagttcgagaccagcctggccaacatgacgaaac

SEQ ID NO: 277495 - DNA, 448 bp, Homo sapiens
ggtgggttcttggtctcactgacttcaagaatgaagctgcggaccctcgctatgatgatatggaagaaaagcactctttggcctgttgtgactgggacagttgacagcacccaggtgtcctttaatgaaaatgctcttgacaccaatgcatcctagcatcacagcttcaggaagccttctcaagtgtgcatggggagtactatgtctttcatcaataatgaaatcttctgatttgtaagacatgctgccaagagatgtgccattctattataaaagatcagtagcttcctttaccgacgtgtatattctatctagaacattgagctatggaagactcccacctaagggaattagttttacaccttcagataaagactgctgagaagagcaccctctggtgttgtcacagaggcaagtgctaccgcacaggcatgctgcagtgaattta

SEQ ID NO: 277496 - DNA, 1110 bp, Homo sapiens
gatctgtaactgtgaatatcatactacgttggttttatttatctgtatgttgttaaattgaaacataacatatgtggtagattcattaaaaaactgaatgcatttattttcttccctgtacctatgccctcttgcaatgtgacttctcacttttcccgtaaagaagtggaatctattttccttcttcttgaatttggaatgcttttggccaagagaaagaggtggaagtgatggtgtaacagttccaagtctaggcctcaagttgcctgtggacttccactcagactctcagagccctgctggaggatggagagaccacatggaacagagaagggttatcccaccgaggccaccatagaccagccagccctcagcgtacatgccagctaattacagatgcaggagcaaacccctggcccatacatcagtgagtagattagcatagatgctcagcaaactcagactcattaggcaaaaagaaatgtttactgtccattaccactaaggttgtctcgttgttaaagagcattatcagtgtcaatagacaactgataaagcatatataaagaaaagagaacaattttttttgtttgtttgttagatggagtttcgctctttcgcccaggctagagggaagtggtgcgatctcggctcactgcaacctctgtcccccaagttcaagcgattctcctgcctcagcctcccgagtagctgggattacaggcatgtgccaccacgcctggctaatttttgtatatttagtagagatgcgttttcaccatgttggccaggttggtcttgaactcctgacctcagatgatccacccgcctcggcctcccaaagtgctgggattacaggcatgagccaccgtgcctggtccaagaacaaattttaagtgtatatagagctcaatgaattatcacaaagtaaacatatatgttaaactagcacctggatcaagaaacagaacattaattgtattccagaaacacctgtgctatcttccaaccactatcccttcccaccaaggttaactactatctcaaccttttatactatagattagttttttccacctccactaaatcatgtcattatatgacttagcc

SEQ ID NO: 277497 - DNA, 1046 bp, Homo sapiens
aaggtctggccatcttctaaagagtttgaacctactgaagaactatcttgactgtcttgatgagggagctgaagaaatccttcactggagtctgagcggaagtggaatctattttccttcttcttgaatttggaatgcttttggccaagagaaagaggtggaagtgatggtgtaacagttccaagtctaggcctcaagttgcctgtggacttccactcagactctcagagccctgctggaggatggagagaccacatggaacagagaagggttatcccaccgaggccaccatagaccagccagccctcagcgtacatgccagctaattacagatgcaggagcaaacccctggcccatacatcagtgagtagattagcatagatgctcagcaaactcagactcattaggcaaaaagaaatgtttactgtccattaccactaaggttgtctcgttgttaaagagcattatcagtgtcaatagacaactgataaagcatatataaagaaaagagaacaattttttttgtttgtttgttagatggagtttcgctctttcgcccaggctagagggaagtggtgcgatctcggctcactgcaacctctgtcccccaagttcaagcgattctcctgcctcagcctcccgagtagctgggattacaggcatgtgccaccacgcctggctaatttttgtatatttagtagagatgcgttttcaccatgttggccaggttggtcttgaactcctgacctcagatgatccacccgcctcggcctcccaaagtgctgggattacaggcatgagccaccgtgcctggtccaagaacaaattttaagtgtatatagagctcaatgaattatcacaaagtaaacatatatgttaaactagcacctggatcaagaaacagaacattaattgtattccagaaacacctgtgctatcttccaaccactatcccttcccaccaaggttaactactatctcaaccttttatactatagattagttttttccacctccactaaatcatgtcattatatgacttagcc

SEQ ID NO: 277498 - DNA, 656 bp, Homo sapiens
aaggtctggccatcttctaaagagtttgaacctactgaagaactatcttgactgtcttgatgagggagctgaagaaatccttcactggagtctgagcggaagtggaatctattttccttcttcttgaatttggaatgcttttggccaagagaaagaggtggaagtgatggtgtaacagttccaagtctaggcctcaagttgcctgtggacttccactcagactctcagagccctgctggaggatggagagaccacatggaacagagaagggttatcccaccgaggccaccatagaccagccagccctcagcgtacatgccagctaattacagatgcaggagcaaacccctggcccatacatcagattttggaagcattgccttctacagaatccacagtagtccgaagctcttctacggtttttgtcaaactttgattttccatctctagcttcaataatctacttgatgtcaactcattcacctcatggcccagggatttctggggtgctataatattgaaaaatacaccattgtatttactctttactgtttttactatgtttactctttactatttaaaaagttgagtgtatatgcattgcatcatctgatccttaactttattaaaaattcaatgaggttatataagataaa

SEQ ID NO: 277499 - DNA, 773 bp, Homo sapiens
tccctagacagggattgggagacatgcaagttgcttggcttcctattaccttgtgttgaaaacacaataggctttgggatcaggagttcattccagttattttaatgttatttactagcagtgtgccctcgtgcacattatcaaactcctctgactcttggaatcctcatttttcaataataactcacaaagctgtcaagcctaagggttctaacagctcgaacagcacctggaacagaagcaatagccgccactcagaggttacttcttccttctccgccttctctggatcacctccctacctcatcctcaatctaacgctggaaatattggatatggggttcttcaatctcaaataaatcatctgtagagtcccctccagttccgaaattctctctatgtcttggagtgtgtggaatagccaggaaaccagcccaggagctttgactcccagccattctacaatgtactgaagatacagcagtaaacagagtggacatggtctccccactatggagcatatttgatgaagaccgatgttaccatacgctataaaaccagagatgccctgcccagtaaggaggaatctagagaagcagtctgtccacagccactttgccacactgtgctcctctgggaggacatttcccttcttcgccatgagtggggattgcagcaacttgttctggcccctgtgcatggctcagcactagcaggacaggaggtagcctcagcggagccctagagaacatcagaagaggcggcgaagcccc

SEQ ID NO: 277500 - DNA, 628 bp, Homo sapiens
cagtggacacagcccgtggtccccgaagccgaaggttgattggagctcttccagggcttccttcctgggccatggacccctctgaggccattcgcctctgttccagtttggctctcctggacccctctggatggctaggttgttcctcctcagtctgcattgattggagctgggaccgaagcccccattccagaaaccggaccaggagataggcaaacaagaagaagccacccaatgtgagaaagaaataagcaacgggggtgatgtccgtctttatgcccagcaaagccagccccagtaggaaggaggcgcagcacaggaggagaagcggcttctccagtctccccagttcttcaatctcaaataaatcatctgtagagtcccctccagttccgaaattctctctatgtcttggagtgtgtggaatagccaggaaaccagcccaggagctttgactcccagccattctgcaccttaagcaaaaaggaagttagccacacatggtggctcatgactgtagtctcagctacatgggaggcaaggcgagaggatctcttgagcccaggagttcgaggccagcctaggcaatgtagtaagaccctgttcttaaatttttttaaaaagcaat

SEQ ID NO: 277501 - DNA, 723 bp, Homo sapiens
gcagtggacacagcccgtggtccccgaagccgaaggttgattggagctcttccagggcttccttcctgggccatggacccctctgaggccattcgcctctgttccagtttggctctcctggacccctctggatggctaggttgttcctcctcaggtgctgggggtatcacaacagtgctgtaggggggtggttggtccaactcttgggggcggcactgggattctagtcccaccacggcctcttcatagactggcacttcaaaggcttcattgtccctgagggaagagaaataaggccattggtggcttccatgaaagaagccctttttcccttttttttgtctgctgtgggcaaaagatcctctgttggcctctgacccctcctcccgctgatgccaatgacaggaaaccagagactctctgcctcagagactacagggagagagggaggatgggcccaaggtgtattcctcttacgatgcccacccttaactcaccgtgcattgcctgagggccctgggctctcagtctgcattgattggagctgggaccgaagcccccattccagaaaccggaccaggagataggcaaacaagaagaagccacccaatgtgagaaagaaataagcaacgggggtgatgtccgtctttatgcccagcaaagccagccccagtaggaaggaggcgcagcacaggaggagaagcggcttctccagtctcccca

SEQ ID NO: 277502 - DNA, 400 bp, Homo sapiens
accttttcagagtttccctttaagcactacttttgcctcatcctacaaattttgctcatccagcgctcacagctgtctgtgtctggaaaaggccaaagagaaaccctctcaccgcgtgtacaaccggcccacaggaggtgcttcaaggagcatgtgacaccaggctgctcctgagggcccgcaggaggacactaaagtcaacaactccctgaagtcaacaactcctgtcctagagccagacacccctgcagccccctggcaccatcagaagtggatggccgttctcacgtcccttgaacttgggaacttcattattcacaagacttcctccaaatgccccactttatattatgaaattttcagacacacagaaaagtagagaatattcttatacaatgac

SEQ ID NO: 277503 - DNA, 757 bp, Homo sapiens
aaggagctctgcagatggcgagggcggcttcacaaggcagtcccctgggcgtggcacacgcccctagcgtaatgtatgagaaatactcatgtggtatatacaaatatacacgaccgcagctatgaaggtctcggcgccagtcggcacgtcagtgcagcacgtgtgtgctccagaaccagaggcagcgtcctccacctcatcccagtctctttaatattccctggcctcttggaactgcttgatgtagtcctcgtccgaggggctctctgtgcacttctgtccgttgttgggaggccgggcctcgttatacctgctccagtcacccttgcagataatccagggcaggacgtccaccttgtagtggagctccgcggagaactcggtgctgatgaggttgggcgtgcccgcccccttgcccctggtgatgagctgcatgttgtcgccgtagcagcagtgctgtgccgccagcgtggtgctctccagggacagcatggagcggatgcagtaccgggcagtgggcttgtagatctccagcttctccttgggcccgctggcgtccttccagcggaagtccttgcgcttgatgcggtcgaagatgtcggccgtgctgtaggccacctcagtggggtaggagcaggggcagctgggcaggtcattcatcaccttgtgcatgtacttctttaagaactcgcttttgcagctcatccagcgctcacagctgtctgtgtcaacttcaaacagtttggtggcattaaac

SEQ ID NO: 277504 - DNA, 444 bp, Homo sapiens
gggaccggcaggctcttgcaaagggctggcgacctccagctgagaccggcggtgttattcccacaccagcataggcccgccatcagacctaaaaagtctaagggtcgccttctagcctggggtttcaactcccagccaagacttccttacagaatgcccaccagaacggctgtgcagacaacaccagccctctggactagagaggagctaccttcctagctgccactgtgacagctggccctggaccctggaagggcagaccaacccacagtcaggaggtcctggcccggccccggccccggcaccagcacccaaaggcaaaaaggcaactcagaaaaacagaggttaataacttgtgagttaaaataaggtacatacaaacatatttggatgtaaacatttgttttaatttatattaataaaaggaaatgctctacttaaaca

SEQ ID NO: 277505 - DNA, 345 bp, Homo sapiens
agagaactgagcatgtcactgttgtttaaaacccctcagtgaccccttctgcatatggcaatgatttcccaaccatattctgccttacaggtgggagggcagggccaatgggatgggatactggtcccccacacctgttgcaatcagagcaatctccttttttaggttttatagaagtggtcgcagagcacctgaaacacacaggcaaggctcccctggtcgggttctgctaacctttctggccccacaggctgcctttctttgtcgtacctcctgtgtctggctctgtcactccttcagtgaagccttcagagagccctcacctgtcgccaacagtcttccctc

SEQ ID NO: 277506 - DNA, 2018 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccaga

SEQ ID NO: 277507 - DNA, 305 bp, Homo sapiens
tactactactaaattcgcggccgcgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttga

SEQ ID NO: 277508 - DNA, 523 bp, Homo sapiens
gagagagagagagagagagagagagagagagagagagagagagagagagagagagaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277509 - DNA, 6982 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctgggagtcaaggggtttttctttctcgctagttttgtgaaaatttttatatcaataggcaaatcattataactttttaggggttgatggtttttaagtatattgggaaattgtgggtgtctaagggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggtttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277510 - DNA, 6864 bp, Homo sapiens
ggcacgagggccggctgagctgagtctcgctgctcggtgcgaggcggcggagagcgaggcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctgggagtcaaggggtttttctttctcgctagttttgtgaaaatttttatatcaataggcaaatcattataactttttaggggttgatggtttttaagtatattgggaaattgtgggtgtctaagggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggtttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277511 - DNA, 6883 bp, Homo sapiens
agcggagccctggtgtgatcgccatcgggaacgccggtcgaggctaggcggggcggggcggcgtggcgcggcggcgggcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctgggagtcaaggggtttttctttctcgctagttttgtgaaaatttttatatcaataggcaaatcattataactttttaggggttgatggtttttaagtatattgggaaattgtgggtgtctaagggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggtttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277512 - DNA, 7441 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtatgaagaagtagtaacttttttttgtcctttaaaaacagtatattgaacttcatgatcatgtttctattatcgtattttactccatattattagggaaacttgatactctgttacactaatgtttaaaaatgttgggccgggggcggtcactcacgcctgtaatcccagcactttgggagactgaggcggacggattgcctgagctcaggagttcgacaccagcctgggcaacatggtgaaacctcatctctactaaaaatacaaaaaattagccgggcgtggttgcacacgcctgtagttccagctaccgggaggctgaggcaggagaatcacttgaacccaggaggtggaagctgcagtgagctgagattgcaccactgcactccagcctgggcaacagagtgagactccatctcaaaaaagaaaaaaaaaggttagagataatgacataactcttttcaatttatttctgacaggagaaggggtgttaatagtcaaactagcttagaaattataattagtatcatgaatatttttataaatctcacagttttttccatttaagtttttctttaattttagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctgggagtcaaggggtttttctttctcgctagttttgtgaaaatttttatatcaataggcaaatcattataactttttaggggttgatggtttttaagtatattgggaaattgtgggtgtctaagggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggtttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277513 - DNA, 5943 bp, Homo sapiens
cgccacgcgtccgcggacgcgtgggcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctgggagtcaaggggtttttctttctcgctagttttgtgaaaatttttatatcaataggcaaatcattataactttttaggggttgatggtttttaagtatattgggaaattgtgggtgtctaagggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggtttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277514 - DNA, 6208 bp, Homo sapiens
  misc_feature (6154)..(6154): n is a, c, g, or t
  misc_feature (6202)..(6202): n is a, c, g, or t
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctgggagtcaaggggtttttctttctcgctagttttgtgaaaatttttatatcaataggcaaatcattataactttttaggggttgatggtttttaagtatattgggaaattgtgggtgtctaagggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttttttttttttccatttttaaaaatgttttaatattttaanctaaaatttttaacttttttgtttgaagctttaacacatgtacaatcncgcgac

SEQ ID NO: 277515 - DNA, 7347 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtaagatgctttggttgaagaagtttatggccaagaatgaattgggtcatagatagagttcagtaaaaacaatactactactgctaggcactggatgaaaagaggactgttaggaaattgctgcttctgcagactggatattacttgcatatgtatttaagatgtcagtttataatactagctttcagatgtaatcccagcagtcatttctgtgctattataaaatacttatgagatacaaataatctttctttacatcaagaacagagatatatgacaaaatatagtttaggaatatatagttatggaatttccaatatttattgaagttttcaataaagattttcctttattcttcattttaggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctgggagtcaaggggtttttctttctcgctagttttgtgaaaatttttatatcaataggcaaatcattataactttttaggggttgatggtttttaagtatattgggaaattgtgggtgtctaagggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggtttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277516 - DNA, 6928 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctgggagtcaaggggtttttctttctcgctagttttgtgaaaatttttatatcaataggcaaatcattataactttttaggggttgatggtttttaagtatattgggaaattgtgggtgtctaagggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggtttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277517 - DNA, 6008 bp, Homo sapiens
aagtctctgcagtgaagttgaggatgacttgctcactaatttcataagtttaacaaaattaaaagttttgtttgactacattattctttgtatttaggtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtaagatgctttggttgaagaagtttatggccaagaatgaattgggtcatagatagagttcagtaaaaacaatactactactgctaggcactggatgaaaagaggactgttaggaaattgctgcttctgcagactggatattacttgcatatgtatttaagatgtcagtttataatactagctttcagatgtaatcccagcagtcatttctgtgctattataaaatacttatgagatacaaataatctttctttacatcaagaacagagatatatgacaaaatatagtttaggaatatatagttatggaatttccaatatttattgaagttttcaataaagattttcctttattcttcattttaggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctgggagtcaaggggtttttctttctcgctagttttgtgaaaatttttatatcaataggcaaatcattataactttttaggggttgatggtttttaagtatattgggaaattgtgggtgtctaagggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggtttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277518 - DNA, 3090 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattccgggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcattta

SEQ ID NO: 277519 - DNA, 3109 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcattta

SEQ ID NO: 277520 - DNA, 5401 bp, Homo sapiens
agcggagccctggtgtgatcgccatcgggaacgccggtcgaggctaggcggggcggggcggcgtggcgcggcggcgggcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattactaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgggaaagatacaaagcacacagttgtctccccacattaggaagagtagtgtgcattcagacattcggaatttttgctagtagttggagatgtttcagtgagtgaattaaaacaaagtctatttaactgacgtgatctattttgtgtctaaaacagaggaatttatcttgtcctagaagttcatgaactataagatctaagtttttttttcttttttaacaataaaatgattttttcttaaagtatcaaagttggaattggctaaaagtgaagtagcataactcagatatgttggaacttggtactgaagcaggctttttggtaacagaaatgacattttaaggggtaactgtatatcctgtttttagttctttgcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctgggagtcaaggggtttttctttctcgctagttttgtgaaaatttttatatcaataggcaaatcattataactttttaggggttgatggtttttaagtatattgggaaattgtgggtgtctaagggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttgtgagctgaacagattaagtatatatctgccaggttgggaaatattttggtctatcttttcctgtcatcagaacttaatttaaaaaaattatcaaaggtcagatgtgactactacagtaagttggctatcataaagaatattccataaaatgttttatctgccatacaaaattactgggtttatggccggatgtggtggctcatgcctgtaatcccagcagttcaggattacaggttatatacaggttataacaatggataccaggacatcagaatatctgataaagcaaatatttatatgctaatttaaaatatcaaattgctactggacataaaatacatctggaagcttggggtaagaagaaagaaaagaagtgttccgttctgttttcaactaagggtaaacgaagtcccagagtgttttccctgtaggtcaaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggtttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277521 - DNA, 2383 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtaagatgctttggttgaagaagtttatggccaagaatgaattgggtcatagatagagttcagtaaaaacaatactactactgctaggcactggatgaaaagaggactgttaggaaattgctgcttctgcagactggatattacttgcatatgtatttaagatgtcagtttataatactagctttcagatgtaatcccagcagtcatttctgtgctattataaaatacttatgagatacaaataatctttctttacatcaagaacagagatatatgacaaaatatagtttaggaatatatagttatggaatttccaatatttattgaagttttcaataaagattttcctttattcttcattttaggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccaga

SEQ ID NO: 277522 - DNA, 384 bp, Homo sapiens
ggaggtgagcctggcatttgctaggaaccagagtggaaccggcaaagtggtcagcaacagagtcctgatccaaatggagaaagggaaccaggcgtacctcaacctgaagtgggaaacttgataggagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcgagggaaaggtccacctccaaa

SEQ ID NO: 277523 - DNA, 3964 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggagaggggcacatattaatttgtatcgcttttgcttctctttggtcttttgtgtcttagaatttggaagtggttcatttctgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttga

SEQ ID NO: 277524 - DNA, 2610 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggacgatatctaatattacagctggaaatagggcacagatccagactgtgatagatgccaacattttcccagccctcattagtattttacaaactgctgaatttcggacaagaaaagaagcagcttgggccatcacaaatgcaacttctggaggatcagctgaacagatcaagtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgttcctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaatctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaacacaggatcagacatcttaagcaaatgtctcaacgtgtattatatgcagatactattcag

SEQ ID NO: 277525 - DNA, 2313 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtatgaagaagtagtaacttttttttgtcctttaaaaacagtatattgaacttcatgatcatgtttctattatcgtattttactccatattattagggaaacttgatactctgttacactaatgtttaaaaatgttgggccgggggcggtcactcacgcctgtaatcccagcactttgggagactgaggcggacggattgcctgagctcaggagttcgacaccagcctgggcaacatggtgaaacctcatctctactaaaaatacaaaaaattagccgggcgtggttgcacacgcctgtagttccagctaccgggaggctgaggcaggagaatcacttgaacccaggaggtggaagctgcagtgagctgagattgcaccactgcactccagcctgggcaacagagtgagactccatctcaaaaaagaaaaaaaaaggttagagataatgacataactcttttcaatttatttctgacaggagaaggggtgttaatagtcaaactagcttagaaattataattagtatcatgaatatttttataaatctcacagttttttccatttaagtttttctttaattttagactgtgatagatgccaacattttcccagccctcattagtattttacaaactgctgaatttcggacaagaaaagaagcagcttgggccatcacaaatgcaacttctggaggatcagctgaacagatcaagtaagtaccaatcaggcagcatattgtaagttaaagaaaaattattattgtgtctatcactttataacctcccacatattacctagagtaaaagattagctgcctttgaggggaaaagtaagtgagagacgatcttaccaaataagaatgtttagttccagtccttaggaaattgtccttggtgtcataattagatgtgtatttaattctttataactctcccatttctttttgctgaaaaacaatcctgggatataagaagtaggcatagtcgaggcttgaggcaatagaaatccttgcttcaacctactctggagctacttgtcagaaatatcttgggtaatataggttacttgtagaacttgagcccaagtttaataactcactcttgccctttttagtttagatgtcttaatag

SEQ ID NO: 277526 - DNA, 1221 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattatatagtggttgacacacttcattccacctttacaagcgtctgggacaatgtcacattcatcaatatctttgcattgctgtctcacaggatcccacgtatatccgta

SEQ ID NO: 277527 - DNA, 1333 bp, Homo sapiens
ggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaattgtgattcaggcaggagctgtgcccatcttcatagagttgctcagctcagagtttgaagatgtccaggaacaggcagtctgggctcttggcaacattgctggagatagtaccatgtgcagggactatgtcttagactgcaatatccttccccctcttttgcagttattttcaaagcaaaaccgcctgaccatgacccggaatgcagtatgggctttgtctaatctctgtagagggaaaagtccacctccagaatttgcaaaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgcataatgattataaagtggtttctcctgctttgcgagctgtgggaaacattgtcacaggggatgatattcagacacaggtaattctgaattgctcagctctgcagagtttattgcatttgctgagtagcccaaaggaatctatcaaaaaggaagcatgttggcatctatcacagtctggatctgtgccctatttccagctgtaatattagatatcgtccaacgtcgacg

SEQ ID NO: 277528 - DNA, 1658 bp, Homo sapiens
acagcaatcaaatcagtgactgccagggactgggaggtgggggtgatagatatattctacttcttaaaaaaaaaaaatcaaagtatatatcctaaaacagtgattttactgtatgtaaattacactcccagaaaccttttttttaattaagtattatttcaaaattctgtttttggacaaaaccaagagccattccaaaacgttcaagaccgtcagcactgatagatgttgaagcaatttactcagtcacaatttaacaaacagctatataaaatcaaagctaaccactgaggcactatttaaccatgtttcccttttttcagtaagactggactattattattacagttcctcattccctaaagttagcgtttcttttcaccactttgttaccagttctcaaattactgtcccaaaaaactgtagtctactcaagaaatctcacaaggagatattttttcctacaagatgctgcggccatttgcacattcttatgcaaaaattaacaacttgacagtcaagcagcaccttcatagcccgtttcaacctatatatggcctaaatatatatggcaaaaataccaatattggtatttttgaaatgcacaaagttccattactgttctgagcaacttttaaaagtctgaaaacatttaattacatatttcttaagattaacaaagtcaaatcctttttccataaaaatcttgccaaaaaaaaaaatcaaccccaaatttctcaatcttcaaaaccagtaaggcacaaaatctaaacccaccgttaccaagaatgcacaaatgggcaagaacgtttacttacacatcttcatgtcatcacaaagggagggggattaactccagaaaggaaccaccataaaacaaacctatggactcaaaactctcaacagaattcctgccagcaacctataatcaaatataggatccttttaacagaaaacacttgatcaaattgctagagaagagcagcacgttaacatgcgcgcagatgactccgattagcaagctttcaagcacttcaaaactatatagactgccacgctttcaaatgcctaactcaagaatcttttccataaagttcgtcccacttccgactgtagtacaaaaaacatcaactcttatcttccctcaatgtcttttccagagggaggcaaggctcagccgtcttccagctcaacgcttctcaacctgagcactactgactttaggggcaggataattcttcgctgagagggggccggggcggttatcttgggcactgcaggaccttcagcagcctctatacactgggtgcccaacaacagccccttctaggagaagccaaccaaaaacgtccccaggcgttgccatctgtcccggggggcggagggaggtgtcaaaatcgcctccggtggatctagctagagcaccgccgcgattctcaagttgcaaggtattcaaggttagcagctgggctggggagcagaaaacacacttggaacgcagggcagacaccctgacgcaggcggcccttccctgaatcggcaatgcagcaaggttatctttacctttgtagagattggtgacggcggtggctgcgttttggaaggggacccagagagaaagtcctggctgctgacacactcggtctgaaaagcaagcc

SEQ ID NO: 277529 - DNA, 1147 bp, Homo sapiens
tgtccaagtcaaagaaaaccgcccgcacgcggctcagccccatagcgccggccgctggcgcgaaccgtagccttgccaccgccgcctgcgcatgcgcaaggcggactgcccagagagacgtgggaggagccgcgaagtcaccagaccatctcccggcgcgggtggaattcccgcgatctgtctcattccctgcgccgccgagaaaagtgagatcccgcgagactcccaggatgaagtctggctctgttgcccaagctggagtgtgttggcaccatcttggttcactgcaacttccacctcccaggctccagtgattctcctgcctcagcctcaagggtagctgagattacaggctggagtgcagtggcatgatctcacctcactgagaacctccacctccagggttcaagtgattctgctacctcaacctcccaaatagctgggactacagggtctcattctgtcacccaggttggagtgcagtggcaacatcatagctcactgcagccttgaacccctgggctcaagtgatcctcctgcttcagcctcctgagtagctggggctacagctttttaactgaaatgatacaagaaaatggctataattttgatagatcatcctctaccatttagtggcataaaagaacttggtcgacagtttggtttaacttttgggcttgatcaggttgaaaccagaaaagccattggcatggtacacaaggatggcgttgaatttggtttaaagagctaattcggaggggaaggcatccactttaaatcgcgatcttagaattccggcgtcacgttcgtcataacatcttgccacgacacaaagacccggctgtttcttgtgacaaacgttagaaccccttaatggtacactcgcaacagaagagtggtgtgggggccaccacagttgttaccacacacacttggtgccagcaggagtaagaagacccgacagaatatgggaacacaacgtggaccgtcagttgaacgaaacttactttggcagccacgagcgagcgcactactcatcagcaactggatctgtgtgccatcaccaccgcatcgaccaccactcatactaacgagctctacccagtacgcccatgctgaggattctgtcgactgacttcccccgaca

SEQ ID NO: 277530 - DNA, 734 bp, Homo sapiens
tgtccaagtcaaagaaaaccgcccgcacgcggctcagccccatagcgccggccgctggcgcgaaccgtagccttgccaccgccgcctgcgcatgcgcaaggcggactgcccagagagacgtgggaggagccgcgaagtcaccagaccatctcccggcgcgggtggaattcccgcgatctgtctcattccctgcggctccagcctgagcaagagtgagactccgtcacaaaaaaaaaaaaaaaaaaaattagtcgggtgtggtggcgagcgcctgtagtcccagctactcaggagtctgaggcaggagaatggtgtgaacgtgggaggcagagcttgcagtgagcggagaccgtgccactgcactccagcctgggcaacagagcaagactccgcatcaagaaaaaaaaaaagttaaatatctccacaggttgcttactctatgttcactctatcctcggttttttgggaacaaactctatttggctagaatatatcatccttttcatgtattgctggatactacttgtccatattttggtgagaattcttgactattttcctctggaatgattacatgtaagggcacatgagaactcttgttgaaatgttctgtatcttgattgaggtgataagtgacctgtgtatactttaaagagtcaaaactcattatacagttaaaagcagtgcttcttacggtatgcaagttacacctcaacactgattaaaaatcctct

SEQ ID NO: 277531 - DNA, 862 bp, Homo sapiens
agccctggaaacgtgtgtcggcgccgccggatgcggcgacttctcagtggctgtggctggcgttggtccgaagcgtggtgttcttccctggtgtctttctgcttatctctttcctccctgggccctccggcgcgagggaccgtcatcacctccccgagagaggttgtccgcgctgccaggcgctgggcagcaggctctccgggtggccgggcgggcggcgcggagacgtcggcgggcctgatgtctgccttgagcgcccgcggtcctagcctgcctaatggcaccattgttgtgcggatgctgatgcccagcgttgagcctgtcgtctcctatattaggggaagttctcctggcccttcccaactacctcccctgtgcaagtttattacaactgaacggcctcaaggatgaagtctggctctgttgcccaagctggagtgtgttggcaccatcttggttcactgcaacttccacctcccaggctccagtgattctcctgcctcagcctcaagggtagctgagattacaggctggagtgcagtggcatgatctcacctcactgagaacctccacctccagggttcaagtgattctgctacctcaacctcccaaatagctgggactacaggaaaacattctgcctgtgttgcaatatccagaaactcctagatatactgatcaacagcagtttgaatgttttcctgatcagtgccattgacatagtcctgactcaccagagaagcaaagcaagcctcgaaagatggctccaattcattcaccaggtactgtgagaaggtctcagagtatctggtgctgcctgaagaagtgaagcctggccccggagctccaatgtgggtagtgg

SEQ ID NO: 277532 - DNA, 536 bp, Homo sapiens
gctgcaagttcgactttaaaaggatccccggcgttttgatgtaaaagagttcccgggaagactccccaggaaatggcaccattgttgtgcggatgctgatgcccagcgttgagcctgtcgtctcctatattaggggaagttctcctggcccttcccaactacctcccctgtgcaagtttattacaactgaacggcctcaaggatgaagtctggctctgttgcccaagctggagtgtgttggcaccatcttggttcactgcaacttccacctcccaggctccagtgattctcctgcctcagcctcaagggtagctgagattacaggctggagtgcagtggcatgatctcacctcactgagaacctccacctccagggttcaagtgattctgctacctcaacctcccaaatagctgggactacagacaggtgtgtgccaccttgcctgctaatttttgtatttttagtaaagacggggtttcaccatgctagccaggctggtctcgaactcctgacctcaggtgatccacccacctca

SEQ ID NO: 277533 - DNA, 314 bp, Homo sapiens
acatctacccagctaccgccagccctttctgttgtttgctggatcccacccttactgaggggcatctttcagcaattctttcctccttggttttgcatcttcaaagttctcccaccctttgaatccactccatttagcatttcactgacaccactccaccgaaactactcttgtcaggccaccaatgaccttcaccttgctcttcaatcgccatttcctggcctcttcttatttgtcctatcagtagcatttgaactagccagtcactgctttctccttgataagcttttttttttctctttctgtttttcttt

SEQ ID NO: 277534 - DNA, 595 bp, Homo sapiens
ttttgactgtgagacttgatctaggaatgaatggaaatgcaactgtagtcatgtttctcctgcattcttccatctgcagaatggcaccattgttgtgcggatgctgatgcccagcgttgagcctgtcgtctcctatattaggggaagttctcctggcccttcccaactacctcccctgtgcaagtttattacaactgaacggcctcaagggcaagtgtgccttctggtttaaagttttctcagattagggcactgtcaggtttatagggatgaaacagaagcaaccagaagagaatcttaggctcccacatctacccagctaccgccagccctttctgttgtttgctggatcccacccttactgaggggcatctttcagcaattctttcctccttggttttgcatcttcaaagttctcccaccctttgaatccactccatttagcatttcactgacaccactccaccgaaactactcttgtcaggccaccaatgaccttcaccttgctcttcaatcgccatttcctggcctcttcttatttgtcctatcagtagcatttgaactagccagtcactgctttctccttgataagctt

SEQ ID NO: 277535 - DNA, 824 bp, Homo sapiens
agccctggaaacgtgtgtcggcgccgccggatgcggcgacttctcagtggctgtggctggcgttggtccgaagcgtggtgttcttccctggtgtctttctgcttatctctttcctccctgggccctccggcgcgagggaccgtcatcacctccccgagagaggttgtccgcgctgccaggcgctgggcagcaggctctccgggtggccgggcgggcggcgcggagacgtcggcgggcctgatgtctgccttgagcgcccgcggtcctagcctgcctgtacgcgcaggtcactgtagaatggcaccattgttgtgcggatgctgatgcccagcgttgagcctgtcgtctcctatattaggggaagttctcctggcccttcccaactacctcccctgtgcaagtttattacaactgaacggcctcaaggatgaagtctggctctgttgcccaagctggagtgtgttggcaccatcttggttcactgcaacttccacctcccaggctccagtgattctcctgcctcagcctcaagggtagctgagattacaggctggagtgcagtggcatgatctcacctcactgagaacctccacctccagggttcaagtgattctgctacctcaacctcccaaatagctgggactacagggtctcattctgtcacccaggttggagtgcagtggcaacatcatagctcactgcagccttgaacccctgggctcaagtgatcctcctgcttcagcctcctgagtagctggggctacaggcactttccctacattttcaaaggcctgcatcatcacatctgccacagcattctctat

SEQ ID NO: 277536 - DNA, 695 bp, Homo sapiens
tgtccaagtcaaagaaaaccgcccgcacgcggctcagccccatagcgccggccgctggcgcgaaccgtagccttgccaccgccgcctgcgcatgcgcaaggcggactgcccagagagacgtgggaggagccgcgaagtcaccagaccatctcccggcgcgggtggaattcccgcgatctgtctcattccctgcgccgccgagaaaagtgagatcccgcgagactcccaggaatggcaccattgttgtgcggatgctgatgcccagcgttgagcctgtcgtctcctatattaggggaagttctcctggcccttcccaactacctcccctgtgcaagtttattacaactgaacggcctcaaggatgaagtctggctctgttgcccaagctggagtgtgttggcaccatcttggttcactgcaacttccacctcccaggctccagtgattctcctgcctcagcctcaagggtagctgagattacaggctggagtgcagtggcatgatctcacctcactgagaacctccacctccagggttcaagtgattctgctacctcaacctcccaaatagctgggactacagacaggtgtgtgccaccttgcctgctaatttttgtatttttagtaaagacggggtttcaccatgctagccaggctggtctcgaactcctgacctcaggtgatccacccacctca

SEQ ID NO: 277537 - DNA, 1739 bp, Homo sapiens
catgaagaatttcaattagatatttcttctacgtagtatagttataactttgcattccattgttttccttctctatagtccattgtatttctgtggggtttttttttttcaggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccataatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctcca

SEQ ID NO: 277538 - DNA, 3135 bp, Homo sapiens
gcgtgcgtaatgggcggagcgaatcgcgccgctgacttccggcccggaggctgagggagtttgtggagtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacaggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccataatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctcca

SEQ ID NO: 277539 - DNA, 2746 bp, Homo sapiens
ggaaagggataggaagtaaatcacaagaaccagagtgaaggaatgtttgataggtttatattgtctttttccatcctcttcagacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacagcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccataatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctcca

SEQ ID NO: 277540 - DNA, 2969 bp, Homo sapiens
gcgtgcgtaatgggcggagcgaatcgcgccgctgacttccggcccggaggctgagggagtttgtggagtcgcgagtgctggtgtccgacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccataatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctcca

SEQ ID NO: 277541 - DNA, 804 bp, Homo sapiens
gcgtgcgtaatgggcggagcgaatcgcgccgctgacttccggcccggaggctgagggagtttgtggagtcgcgagtgctggtgtccgcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggtaagactcccttggctctgatggtcaaaggatggcaaagtccactttagaggccattagcctagcagttgagtaggagctgtcactgatcctggcatcatcatcatcttgatgtgtgaccctatccaagttttggttttcatggagttaaaggttattccccttgcattttacagccctgattttgcatttgccaacctctttcaactaagttcatgtcatcttttcccatgg

SEQ ID NO: 277542 - DNA, 3131 bp, Homo sapiens
ggaaagggataggaagtaaatcacaagaaccagagtgaaggaatgtttgataggtttatattgtctttttccatcctcttcagacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacaggttctagattctgagaaggacttgaaagtactcatgaaggagatggcccctttgggagcaaccagagaatcactgagatcccaatggaaacaggaggttcagccagaggaaccgacttttaagggatcacagagctcacaccaaagaccaggggaacagtcagaagcctggcttgctcctcaggctcccaggaacctgcctcaaaacacaggtctccacgaccaggagacaggtgctgtggtctggacagctgggtcccagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccataatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctcca

SEQ ID NO: 277543 - DNA, 1353 bp, Homo sapiens
ggaaagggataggaagtaaatcacaagaaccagagtgaaggaatgtttgataggtttatattgtctttttccatcctcttcagacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacagcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggtaagactcccttggctctgatggtcaaaggatggcaaagtccactttagaggccattagcctagcagttgagtaggagctgtcactgatcctggcatcatcatcatcttgatgtgtgaccctatccaagttttggttttcatggagttaaaggttattccccttgcattttacagccctgattttgcatttgccaacctctttcaactaagttcatgtcatcttttcccatgg

SEQ ID NO: 277544 - DNA, 1146 bp, Homo sapiens
  misc_feature (1141)..(1144): n is a, c, g, or t
  misc_feature (1146)..(1146): n is a, c, g, or t
tcctgagctcaagcgattctccctcctcaggctccctaaccctaaccccaaccttagggcagctgggaccacaggcccgcccgaccacactccgctaatattttttattttttgtagagacaggattttgctttgttgctcaggctaatttctaactcctgacctcaaatgatccttgtgacttggcctcccaaactggtggaattacaggcgggagccaccataccagtcaggacgcacatcttaaggatactcccgaggtgaagctgggcttttcctgcagaagcgcctctgggaattgcgccctttaccctccttgttgcctagggaactacattacccagaaaactcagcctcgaatgatagcgtagaagacctctgagggctcagaataaaggcgtttcctgtgtgcacgtgacaatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctggggatgacatttctccatgtttgtcaggccttggactctctacgtcaggtgatccacccacccacctcggcctcccaaagtgctgggattacaggtgtgagccactgcgcctgacccttgcaggatctcactctattccccaggctagagtgcgatggcaccatctcggctgattgcaacctccattttccaggaaggctctttaattccccctgattacaaaggttttgtgtgaacataatttggtgtaataaaaaaaaatttacaccacaagagacaaacataaannnnan

SEQ ID NO: 277545 - DNA, 1110 bp, Homo sapiens
tcctgagctcaagcgattctccctcctcaggctccctaaccctaaccccaaccttagggcagctgggaccacaggcccgcccgaccacactccgctaatattttttattttttgtagagacaggattttgctttgttgctcaggctaatttctaactcctgacctcaaatgatccttgtgacttggcctcccaaactggtggaattacaggcgggagccaccataccagtcaggacgcacatcttaaggatactcccgaggtgaagctgggcttttcctgcagaagcgcctctgggaattgcgccctttaccctccttgttgcctagggaactacattacccagaaaactcagcctcgaatgatagcgtagaagacctctgagggctcagaataaaggcgtttcctgtgtgcacgtgacaatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctggatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaaaaaaactc

SEQ ID NO: 277546 - DNA, 983 bp, Homo sapiens
tcctgagctcaagcgattctccctcctcaggctccctaaccctaaccccaaccttagggcagctgggaccacaggcccgcccgaccacactccgctaatattttttattttttgtagagacaggattttgctttgttgctcaggctaatttctaactcctgacctcaaatgatccttgtgacttggcctcccaaactggtggaattacaggcgggagccaccataccagtcaggacgcacatcttaaggatactcccgaggtgaagctgggcttttcctgcagaagcgcctctgggaattgcgccctttaccctccttgttgcctagggaactacattacccagaaaactcagcctcgaatgatagcgtagaagacctctgagggctcagaataaaggcgtttcctgtgtgcacgtgacaatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagatcctgcactggatggatcagcggacaacacacagaccggtaatctgggtcaatcagttctgccatcccacccagaacagaaaacagcatgaaaaactcactttaaccccctatgaatccatctccaaccagactgatcagcactccccacttcccaagcccctacccgccaaattttgaaaactctgatcccagaatgctcagggagactgatttgaataataaaactcctgtctcccgaacagcaaaaaaactc

SEQ ID NO: 277547 - DNA, 2564 bp, Homo sapiens
tcctgagctcaagcgattctccctcctcaggctccctaaccctaaccccaaccttagggcagctgggaccacaggcccgcccgaccacactccgctaatattttttattttttgtagagacaggattttgctttgttgctcaggctaatttctaactcctgacctcaaatgatccttgtgacttggcctcccaaactggtggaattacaggcgggagccaccataccagtcaggacgcacatcttaaggatactcccgaggtgaagctgggcttttcctgcagaagcgcctctgggaattgcgccctttaccctccttgttgcctagggaactacattacccagaaaactcagcctcgaatgatagcgtagaagacctctgagggctcagaataaaggcgtttcctgtgtgcacgtgacaatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctggtctatgcaacaaggtccagccagatgaagcctgtagccaggtagaactgtggtaatatcacctcctgactttgatccgttttatctctaagcatttcacaacctggtagcaaatcctgggttaatcttacaagggtgtttacattggttgacagaaatgggaatacctccatataacctgtcatggacttggtatcctggcttcagagattctccagggtcctcggatcaaaggactgaaaaaaatggcacttaagagtcccaggacaccacaagctagagaacctgtagatggcgtcaggaccaatgagggaatggaacaccctccacttccctgtgtgggttccctaagtgcttctgcagccaggagtgcctgaggggaaaggcagacattacaaacatgtcacaggatttgataagctcaggactccctgaaccctttcttgtccctggaaccaggtaaccctaaggctggttgtctgacctgcttttctcagtgcaaaatgtcatctctaccatctatgtgatctacaaaacggattcaacctcccaaggccccaaagtcctcatcctctctctctatgatgttcttcctttgattggcctttgggaaacttcttaaaagcctggatttggatcatgtccctcctttcttcaaaactctccatggcttctagaatcctcatgatgaatgcacagcccctggcctgcttgctctaccaggaagagctccatctcacacgttgttcctgacagatgcctgtgaaccccaggttccatccttccagctctgtccatctgcaggccattgcctgcacccctacctgtgcctgtcactctccccactgcatcccactggtgtcagaaacaggtgaaaccgactttgcaaaattataactgacgaaattatgacagtgaaagaaatcagacctaaccgactccatcttgcttccaacctttcagccgtcttttttcattcctgggcataggctgaattaactttggaaaagaattcagttcatggtttcactctgaaacaaaattgataatagccctttcctgaaaagacccctttcttgcctggggaccagcctgtctttgcaggactaacaaattagctacaagaatagaaattacggtttaggggtcatgcagcttctggctccaagagtctgaacctccccaagttgctcctgaagataaccttactattgtaaaacctaatgtgagtttctggggtgctagttgagttggtctcccctgtgtgagacacccatgggaagccatgggcggcctctgaggagaaaagtctccttattgccttcatgtctttatgccccgagagcataactcttcagcagcattccatgggttgctcagggagatcacactcccttgaagcagtggagcataatcaaacatcttggctcctcctgaaacccgcagccacccgtttcagttaagttaaagatcttaagtagtttagacacacgcctttgttcaaggaaattcacagaaacggccagtgctttacatcttatggaatgactcacgagttctcctttactgattaatccttttcctgatcgcttcctccccctccaatcagccataagaacaaagagcttgtaaaccaataaactgggtggagcccaagagctctgggccgccaggaagcctccaatgctctggccacctggacccgcctttt

SEQ ID NO: 277548 - DNA, 1425 bp, Homo sapiens
tcctgagctcaagcgattctccctcctcaggctccctaaccctaaccccaaccttagggcagctgggaccacaggcccgcccgaccacactccgctaatattttttattttttgtagagacaggattttgctttgttgctcaggctaatttctaactcctgacctcaaatgatccttgtgacttggcctcccaaactggtggaattacaggcgggagccaccataccagtcaggacgcacatcttaaggatactcccgaggtgaagctgggcttttcctgcagaagcgcctctgggaattgcgccctttaccctccttgttgcctagggaactacattacccagaaaactcagcctcgaatgatagcgtagaagacctctgagggctcagaataaaggcgtttcctgtgtgcacgtgacaatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagagaatctcgctctgtcgcccaggctggagtgcagtgggcctgatcttggctcactgcaaactccgcctcctgggttcacgccattctcctgcctcagcctcctgagtagctgggacaacaggtgcgtgccaccacacctggctaactttcggtatttttagtagagatggggtttcactgtgttagccaggatggtctcgatctcctgaccttgtgatccgcccacctcatcctctcaaagtgctgggattacaggtgtgagtcactgtgcccggccgtgttgtcacttttaatgtgctttggttttaattttctgtagaaaagtaaaacaaatttttccctttaaatttaatccttgcttttaatgacttgtgcaccccaatttactaagaaaataaaccatttaaaaaataatcttgagttgggcatagtagtttattcctgtaatcccaacacattgggaggcagaggcaggctgttgacttgagccgaggagattgagaccagcctgggcaacatggcaaaaccctgtgtccacaaaaaatgcaaaaattagccaggcagggtgcctgtctgtagtcccagctacccagcaggctgaggtggcacgatcacttgaaccctgggggtggtcaaggctgcagtgagccatgatcatgccactgcactccagcctgggcagcagagcaagattctct

SEQ ID NO: 277549 - DNA, 1062 bp, Homo sapiens
tttaagacaaggatctagctctgttgcctaggctggagggcaatggcatgatcacagcttactgcaacctctgctcctgcattcaagcgattctcatgcctcagcctcccgaacatctgggattacaggtgcatgataccacatccggctaatttttggatttttagtagagactgtttcacggtattggcctgactggtctcgaactcctgtcctcaagtgacccacctgtcttggcctcccaaagtgggattacaggcatgaaccactgcacccagcctaaatgactaccttttatgttgcacattttaagtaacttttgtcatttccatcttgggttgttgctttttttgttttttgagacagaatctcgctctgtcgcccaggctggagtgcagtgggcctgatcttggctcactgcaaactccgcctcctgggttcacgccattctcctgcctcagcctcctgagtagctgggacaacaggtgcgtgccaccacacctggctaactttcggtatttttagtagagatggggtttcactgtgttagccaggatggtctcgatctcctgaccttgtgatccgcccacctcatcctctcaaagtgctgggattacaggtgtgagtcactgtgcccggccgtgttgtcacttttaatgtgctttggttttaattttctgtagaaaagtaaaacaaatttttccctttaaatttaatccttgcttttaatgacttgtgcaccccaatttactaagaaaataaaccatttaaaaaataatcttgagttgggcatagtagtttattcctgtaatcccaacacattgggaggcagaggcaggctgttgacttgagccgaggagattgagaccagcctgggcaacatggcaaaaccctgtgtccacaaaaaatgcaaaaattagccaggcagggtgcctgtctgtagtcccagctacccagcaggctgaggtggcacgatcacttgaaccctgggggtggtcaaggctgcagtgagccatgatcatgccactgcactccagcctgggcagcagagcaagattctct

SEQ ID NO: 277550 - DNA, 1217 bp, Homo sapiens
  misc_feature (1212)..(1215): n is a, c, g, or t
  misc_feature (1217)..(1217): n is a, c, g, or t
tcctgagctcaagcgattctccctcctcaggctccctaaccctaaccccaaccttagggcagctgggaccacaggcccgcccgaccacactccgctaatattttttattttttgtagagacaggattttgctttgttgctcaggctaatttctaactcctgacctcaaatgatccttgtgacttggcctcccaaactggtggaattacaggcgggagccaccataccagtcaggacgcacatcttaaggatactcccgaggtgaagctgggcttttcctgcagaagcgcctctgggaattgcgccctttaccctccttgttgcctagggaactacattacccagaaaactcagcctcgaatgatagcgtagaagacctctgagggctcagaataaaggcgtttcctgtgtgcacgtgacaatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggttgttggtgtggagtggaagatgaggcggcaccttctaagcagagtatttatatacaaagagagactcagggatgacatttctccatgtttgtcaggccttggactctctacgtcaggtgatccacccacccacctcggcctcccaaagtgctgggattacaggtgtgagccactgcgcctgacccttgcaggatctcactctattccccaggctagagtgcgatggcaccatctcggctgattgcaacctccattttccaggaaggctctttaattccccctgattacaaaggttttgtgtgaacataatttggtgtaataaaaaaaaatttacaccacaagagacaaacataaannnnan

SEQ ID NO: 277551 - DNA, 1076 bp, Homo sapiens
tcctgagctcaagcgattctccctcctcaggctccctaaccctaaccccaaccttagggcagctgggaccacaggcccgcccgaccacactccgctaatattttttattttttgtagagacaggattttgctttgttgctcaggctaatttctaactcctgacctcaaatgatccttgtgacttggcctcccaaactggtggaattacaggcgggagccaccataccagtcaggacgcacatcttaaggatactcccgaggtgaagctgggcttttcctgcagaagcgcctctgggaattgcgccctttaccctccttgttgcctagggaactacattacccagaaaactcagcctcgaatgatagcgtagaagacctctgagggctcagaataaaggcgtttcctgtgtgcacgtgacaatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagcagcttcttcttggcacaatcctgaactgggcagaacgtccttcccaaactcgcggaagacaaatggctcctgtgacaccctgagcttacgtttctttacaaacgatgcttctctgacactctttctgtagaatttctctccaatatgctgcttctggtgctgatgaaggtatgcagtgtcatccaagttttttccacatgctccatcctgtaatcccagcactttgcaaggccgaggcgggcagatcacctgacgtcaggagttcgagaccagcctggctaatatagtgaaaccctgtatctactttgggaggctgaggcaggagaatcgcttgaacccaggaggcag

SEQ ID NO: 277552 - DNA, 809 bp, Homo sapiens
  misc_feature (804)..(807): n is a, c, g, or t
  misc_feature (809)..(809): n is a, c, g, or t
aacaaacaaacaaacaaaaaaatatactttaagttgtttaaaggccagagagaggccagtggtgtgtggcagtcacctggggatggacatggaatgtacctggaagtctaaagaatgaggtgtgttcagagagggtatctctgctgtgctgaaggtgccacattgggctttccatgaccttggccatactagggaaagtgcctgtcaggagggggtggactcttacgtcacaaccaccacacagatacctatttgttcaactattgttggtggctataccccatgaccagtgggcctagtttctcctatgtttgaggaccttgagaggaggatgtgcgagagtagatgtgtgggagagatggattgtgatacctcagcataggggcagtttgtagtttcatctgtcaacatcataacagggcacagtgacttttgaagatgtggctgtgaactttacctgggaggaatggaatctccttagtgaggctcagagatgcctgtaccgtgatgtgacgctggagaacctggcacttatatcctccctggggatgacatttctccatgtttgtcaggccttggactctctacgtcaggtgatccacccacccacctcggcctcccaaagtgctgggattacaggatctcactctattccccaggctagagtgcgatggcaccatctcggctgattgcaacctccattttccaggaaggctctttaattccccctgattacaaaggttttgtgtgaacataatttggtgtaataaaaaaaaatttacaccacaagagacaaacataaannnnan

SEQ ID NO: 277553 - DNA, 1748 bp, Homo sapiens
ttatctctgacctttcttcctcttccctcaacccacagtctatgcaacaaggtccagccagatgaagcctgtagccaggtagaactgtggtaatatcacctcctgactttgatccgttttatctctaagcatttcacaacctggtagcaaatcctgggttaatcttacaagggtgtttacattggttgacagaaatgggaatacctccatataacctgtcatggacttggtatcctggcttcagagattctccagggtcctcggatcaaaggactgaaaaaaatggcacttaagagtcccaggacaccacaagctagagaacctgtagatggcgtcaggaccaatgagggaatggaacaccctccacttccctgtgtgggttccctaagtgcttctgcagccaggagtgcctgaggggaaaggcagacattacaaacatgtcacaggatttgataagctcaggactccctgaaccctttcttgtccctggaaccaggtaaccctaaggctggttgtctgacctgcttttctcagtgcaaaatgtcatctctaccatctatgtgatctacaaaacggattcaacctcccaaggccccaaagtcctcatcctctctctctatgatgttcttcctttgattggcctttgggaaacttcttaaaagcctggatttggatcatgtccctcctttcttcaaaactctccatggcttctagaatcctcatgatgaatgcacagcccctggcctgcttgctctaccaggaagagctccatctcacacgttgttcctgacagatgcctgtgaaccccaggttccatccttccagctctgtccatctgcaggccattgcctgcacccctacctgtgcctgtcactctccccactgcatcccactggtgtcagaaacaggtgaaaccgactttgcaaaattataactgacgaaattatgacagtgaaagaaatcagacctaaccgactccatcttgcttccaacctttcagccgtcttttttcattcctgggcataggctgaattaactttggaaaagaattcagttcatggtttcactctgaaacaaaattgataatagccctttcctgaaaagacccctttcttgcctggggaccagcctgtctttgcaggactaacaaattagctacaagaatagaaattacggtttaggggtcatgcagcttctggctccaagagtctgaacctccccaagttgctcctgaagataaccttactattgtaaaacctaatgtgagtttctggggtgctagttgagttggtctcccctgtgtgagacacccatgggaagccatgggcggcctctgaggagaaaagtctccttattgccttcatgtctttatgccccgagagcataactcttcagcagcattccatgggttgctcagggagatcacactcccttgaagcagtggagcataatcaaacatcttggctcctcctgaaacccgcagccacccgtttcagttaagttaaagatcttaagtagtttagacacacgcctttgttcaaggaaattcacagaaacggccagtgctttacatcttatggaatgactcacgagttctcctttactgattaatccttttcctgatcgcttcctccccctccaatcagccataagaacaaagagcttgtaaaccaataaactgggtggagcccaagagctctgggccgccaggaagcctccaatgctctggccacctggacccgcctttt

SEQ ID NO: 277554 - DNA, 1254 bp, Homo sapiens
tcctgagctcaagcgattctccctcctcaggctccctaaccctaaccccaaccttagggcagctgggaccacaggcccgcccgaccacactccgctaatattttttattttttgtagagacaggattttgctttgttgctcaggctaatttctaactcctgacctcaaatgatccttgtgacttggcctcccaaactggtggaattacaggcgggagccaccataccagtcaggacgcacatcttaaggatactcccgaggtgaagctgggcttttcctgcagaagcgcctctgggaattgcgccctttaccctccttgttgcctagggaactacattacccagaaaactcagcctcgaatgatagcgtagaagacctctgagggctcagaataaaggcgtttcctgtgtgcacgtgacaatgggtccggacttccggcgccctctggtggcggccattttgattggtgttggatttatttgtaggagaggctcctgagcgctaggtccgcactgtggtgactgaacccagaagtcggggagcagttgtcctccgctgcacagaggctactctggagctctgtgacggcgcccagcgtgacccactcctgggccaggatacggaccgtcgtgcccatatctcctggctggtcgccctatcctcccgactctgcttaaaaccacgtggttcgatggctgccgcggctacgctgaggctctccgctcagggcacagtgacttttgaagatgtggctgtgaactttacctgggaggaatggaatctccttagtgaggctcagagatgcctgtaccgtgatgtgacgctggagaacctggcacttatatcctccctgggtaagttgctcacactcaccctgtgacctgagctagtctctgttttcccctatctttccccattggtaagactttctcatgtcaggagcatggacacagcttcctgcttcagttctgtgggtaggttcttggttggtaggtctgaggtgtacatactgccctactcctttcttggagcagccccaacacctgctttactgcaggctcccagggagggattcccagtcagaagcccaccttgttagtcctgtggatgtttgggtgtccttgtccagatttcaggttcctgtgtgcccacagtctacttcctttctctagctgctattttcttatgccttcctgtggcaggaattgccttcacagactacatcactgcctatatagaccagaggctgttctt

SEQ ID NO: 277555 - DNA, 946 bp, Homo sapiens
aacaaacaaacaaacaaaaaaatatactttaagttgtttaaaggccagagagaggccagtggtgtgtggcagtcacctggggatggacatggaatgtacctggaagtctaaagaatgaggtgtgttcagagagggtatctctgctgtgctgaaggtgccacattgggctttccatgaccttggccatactagggaaagtgcctgtcaggagggggtggactcttacgtcacaaccaccacacagatacctatttgttcaactattgttggtggctataccccatgaccagtgggcctagtttctcctatgtttgaggaccttgagaggaggatgtgcgagagtagatgtgtgggagagatggattgtgatacctcagcataggggcagtttgtagtttcatctgtcaacatcataacagggcacagtgacttttgaagatgtggctgtgaactttacctgggaggaatggaatctccttagtgaggctcagagatgcctgtaccgtgatgtgacgctggagaacctggcacttatatcctccctgggtaagttgctcacactcaccctgtgacctgagctagtctctgttttcccctatctttccccattggtaagactttctcatgtcaggagcatggacacagcttcctgcttcagttctgtgggtaggttcttggttggtaggtctgaggtgtacatactgccctactcctttcttggagcagccccaacacctgctttactgcaggctcccagggagggattcccagtcagaagcccaccttgttagtcctgtggatgtttgggtgtccttgtccagatttcaggttcctgtgtgcccacagtctacttcctttctctagctgctattttcttatgccttcctgtggcaggaattgccttcacagactacatcactgcctatatagaccagaggctgttctt

SEQ ID NO: 277556 - DNA, 4127 bp, Homo sapiens
agtgggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 277557 - DNA, 959 bp, Homo sapiens
cgcggtaaaaatttgccgcggagtcgtgcctccggtggggccgagttctctcatgccgcccgcattatgtccgcttatgtgttaccccccctagtaccccggcttgaatgtgtttatagttctcgcctctgggggcgtgttaattacttccgctacggaggtgaggttgtggccgcaccgtagttgttctcccccccccgggtgtttaggggtgctccgttcccccaaggggtcccccacggctgtccacctcgtttttcccgcctccacgcggccgttgtttaaacgaggggccccggcgggcgttggccttttataagggcggcccccctttggggcccccctgtgcccaaaaactgggggccgccgtaattgggcggccccccgggggagtttttttgggcgcgcgcgcccccccttttttttttttttttttttttttttttttttttttggtttcgtggtttcgtctatttattaaaaaatatttgagaacaaaacctctgcctctttgagtcttgctctggcatccccagcatctctgattctccctggtgcccccagctcaggaagaaggtggtagtggggagagagggtcaggggggcttggcagggatgcaggcaccatgacttttgtgaccagttcctagagacgcatgggtgtagcctcaggaggaaagcgagaggagctttaccatgggaacgaaggaaagggacaacattgggaggcaaacgttgggagactagtccagaaacttgcagttgaggatacaacagggtcctagtgtttcctccctgggtcagcgtagaagtagagctttttcactgtcgaaggcgggattgaagttagagattgccctggcagaggttggggagagagggactaggaggtggtacatgaatgtcttctctcattctgctaggtccctctcagtggaagatagataggctggtgggtg

SEQ ID NO: 277558 - DNA, 453 bp, Homo sapiens
ggcagctattttggatataagattagtttgagaagacttcctggaggaggggagtttgaggtcaaatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 277559 - DNA, 967 bp, Homo sapiens
ggcaagagttcaaggattgagagaaagccctctcaggaggaccagtcagagggaagggctgagcctgcagaaaaggcagaaggtggaagaggacctgccgatggacttggagactgagatgagggtcagtgatggggccacgggggctcccatggcaaggaatagcaatccttcacagtacactaataatatgcagtctacatacatctcattggttagtcttcaaacctctgtgaggtaggaattatattagtctcattttatagatggagaactgaagcctagagaggttaagttacttggccaaggtaagtaatggtggagctgagatgagaacggaggtcccctgactcccagtcgtgtgtacagaggcctgaggcttggacgggtgtgatggggacctggggtgggaagagaggctcagggagtgaaggcaggtactgggggagcagactgggcgggggaatggtagggggaggtgttcagaacttagcaggagtggggtctgactctccagggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggtgaggacctgggggcaggatggggtggggtcttgaggggctccagtaacccagactgaccttgccttctctcccattccaggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgtaagccaggcggg

SEQ ID NO: 277560 - DNA, 4586 bp, Homo sapiens
agtgggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaacctctgcctctttgagtcttgctctggcatccccagcatctctgattctccctggtgcccccagctcaggaagaaggtggtagtggggagagagggtcaggggggcttggcagggatgcaggcaccatgacttttgtgaccagttcctagagacgcatgggtgtagcctcaggaggaaagcgagaggagctttaccatgggaacgaaggaaagggacaacattgggaggcaaacgttgggagactagtccagaaacttgcagttgaggatacaacagggtcctagtgtttcctccctgggtcagcgtagaagtagagctttttcactgtcgaaggcgggattgaagttagagattgccctggcagaggttggggagagagggactaggaggtggtacatgaatgtcttctctcattctgctaggtccctctcagtggaagatagataggctggtgggtg

SEQ ID NO: 277561 - DNA, 4474 bp, Homo sapiens
  misc_feature (4325)..(4325): n is a, c, g, or t
agtgggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaaaaaagaagcactgcaagagcaccaaacactttttgtcgggcagcatatcggggcctttgaaagaaggtgttacttaaagaccatttctgttgggggcgcggggcgccccggggaggtgtactgtcaccttgggtggccaaggcggtggtcccccaaaagagagcactcggggcacagcgacacggtggctcgggggtnctccccaccaagtataaagaaccggcccggggggaacacccggaggcgtttgggaacaaacttcccaaagggggaggcccgaggagaccaacagggggtgcattcacacaggagcgccagggagagccgagattaaataccggagagag

SEQ ID NO: 277562 - DNA, 4109 bp, Homo sapiens
agtgggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 277563 - DNA, 2418 bp, Homo sapiens
ggcaagagttcaaggattgagagaaagccctctcaggaggaccagtcagagggaagggctgagcctgcagaaaaggcagaaggtggaagaggacctgccgatggacttggagactgagatgagggtcagtgatggggccacgggggctcccatggcaaggaatagcaatccttcacagtacactaataatatgcagtctacatacatctcattggttagtcttcaaacctctgtgaggtaggaattatattagtctcattttatagatggagaactgaagcctagagaggttaagttacttggccaaggtaagtaatggtggagctgagatgagaacggaggtcccctgactcccagtcgtgtgtacagaggcctgaggcttggacgggtgtgatggggacctggggtgggaagagaggctcagggagtgaaggcaggtactgggggagcagactgggcgggggaatggtagggggaggtgttcagaacttagcaggagtggggtctgactctccagggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 277564 - DNA, 4240 bp, Homo sapiens
agtgggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagtgtggcttcttccatcggagcagccagagctcatcttttcccaccaactatcaccgggcctgtctggctgtgcagccttcagccatggaagttgggggtccagggactgtgggatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 277565 - DNA, 372 bp, Homo sapiens
ggatgataatgtgcaccttgtaggactattgcgaagcttaagtgagataagtgcctgacaagtagtaggtgctcaataaatgggactgtcattaggtaacataagcatcacttggggaagctactctgcctgtgctgtcaagtaagagattcccttccatgctgccccctccacgcatttcaaagctgaatagctcagatttggggcaggcagctattttggatataagattagtttgagaagacttcctggaggaggggagtttgaggtcaagtaaggaaaatgggagagatggcagtctcagcagggttgagctgagtggcttagacccctgtctgtccttatccctaggactgcgcccggggcacggcc

SEQ ID NO: 277566 - DNA, 338 bp, Homo sapiens
gtctttctgtctctggctgtgatctctctggtctctttttctctctccacctcttcttcttccaccattttctggcctttctgtggctctgtctccctactctgtggcccctactctggatgtcccctccctggtgtctcaccccaccccccacagggttgctttttgtgaccaacattgatagctcagaccccgaccagctggtgtataaaactttggaccctgctgaccggctcccaggaccagccggagacttggccctcaatagctacttaggtttgtaagctcccacctcctggactctaggggcatggcccagcctcccctccttccccagg

SEQ ID NO: 277567 - DNA, 363 bp, Homo sapiens
gttgggcaccattacatttataatttcaggaggtaaggggaagggagggagacatggggcatttaggagaagggtctccttccctgttcccttaggagtactcagctgtgaagtccctggaagtgattgtccgggccaacatcacagtgaagtcctccataaagaacttgatgctccgagatgcctccacagtggtgagctgcagggttgggggataggtggggaggactctcttctttcctgctccctccagttcttgttccattgacctcttgctccattgaccccttgctccccagatcccagtgatggtatacttggaccccatggctgtggtggcagaaggagtgccctggtgggtca

SEQ ID NO: 277568 - DNA, 3535 bp, Homo sapiens
ctctagaggatctctcgctatcatcggcaccccatgccttccaccccattgagctagtgcacacatgaatggggggtgcctcctttccctcgcacggccaagtgctcctcaacatgctggcatgggccccaagtgcacgctgggcctgcagctggggcctgcatgctccaacacactagcccacacctcatcactgccattcccgtctccgcacgctgctgctggctgagctgacactcgggttgctttttgtgaccaacattgatagctcagaccccgaccagctggtgtataaaactttggaccctgctgaccggctcccaggaccagccggagacttggccctcaatagctacttagggggactttccctgaggggatggatggtgggcacatattgaagaaagggctaatgttgttggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 277569 - DNA, 2500 bp, Homo sapiens
ggcaagagttcaaggattgagagaaagccctctcaggaggaccagtcagagggaagggctgagcctgcagaaaaggcagaaggtggaagaggacctgccgatggacttggagactgagatgagggtcagtgatggggccacgggggctcccatggcaaggaatagcaatccttcacagtacactaataatatgcagtctacatacatctcattggttagtcttcaaacctctgtgaggtaggaattatattagtctcattttatagatggagaactgaagcctagagaggttaagttacttggccaaggtaagtaatggtggagctgagatgagaacggaggtcccctgactcccagtcgtgtgtacagaggcctgaggcttggacgggtgtgatggggacctggggtgggaagagaggctcagggagtgaaggcaggtactgggggagcagactgggcgggggaatggtagggggaggtgttcagaacttagcaggagtggggtctgactctccagggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggtgaggacctgggggcaggatggggtggggtcttgaggggctccagtaacccagactgaccttgccttctctcccattccaggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 277570 - DNA, 702 bp, Homo sapiens
ctccttgaactgctgtcggtcttcccgaggaatcttcaccgcatggtactggggcagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 277571 - DNA, 379 bp, Homo sapiens
gctgagggtcacctcaagccccacctgcccatgattcttctgatggagactcacaacaggctatggtctgggctatctctgtggggtgcaatgtctgctctctgtatcaatacagagggtgacaaacactatgtggatgccgaccggggctgcagagatttaacagtgccatggggtcccgattgcactcaccatccacaccatcatgtaggagaaggctgcgatccacagcgtggaggaagcaaacgtcaccatgaaccatttctcccagcgcggcttgttgcagttgggtacagtgaagtataagacgaaactcagcggccaggtgaacgcccatttcactgtttccagtttacccgctggaaaaatgaaaaaggcc

SEQ ID NO: 277572 - DNA, 628 bp, Homo sapiens
tatatggaggcggcggcggcggcgcgggggagggggcgggggcgcgatcgatggaatataattttcctcaaactcggaaaataaagttcagagctgatcaaatttgaaaacagatgtcgaatcgcgactctaaataaggtcaggctccgccccgccaagtcccacaccaccttctctggggaaaggcagctctcacctgggcagcccctggaggcttctacccctagaggggaaaataggtctcacggcaagacagcagtccccaggtggatattcaggggccaggacagctctgtcggatctcaccaaccccaccagcgcccaggtgctgagaccgaggtgctgagaggctagaagagaacttcagccctgcctgacagagaaggttcagcctcactcccgctcaccactcactcaggcaagtcgctaaacatccccgagcctcaagtttcctcatctgcaaaatgggacaataatgacctccctcctagagtggttgggaaggttaaaccgcagggcgcatggagcacagctggtactgcaccaagtaccaagtaaacacgcatttgctgtgagcttgctgcttccgaataatctcattaaaaatattaagaattttgccagataa

SEQ ID NO: 277573 - DNA, 329 bp, Homo sapiens
ccaagagatagagagactcagaatcaagacaggcagacatggacagggacaaggagacaggggcaggtggtggcaaaggtggaaatggagaaaggaaatgaaagtgagggtgggtgtaacttggccaaagtcccacagggatgaggtgagcctggacttgaatgcaggtcagtatgactctaggcccccgatatttgtactgtcagaggacagagcaagggccagagacagaaaaggaggaaagagacaagacaaggagacagacacagagtccaggatatggagaaactgagagagagtcagagagctgtaaagaccctgtgggagaa

SEQ ID NO: 277574 - DNA, 204 bp, Homo sapiens
cggccgcccggccgggctcggctcgcagatatatggaggcggcggcggcggcgcgggggagggggcgggggcgcgatcgatggaatataattttcctcaaactcggaaaataaagttcagagctgatcaaatttgaaaacagatgtcgaatcgcgactctaaataaggttcgatcccgggactgagggagtgggggtggggcgg

SEQ ID NO: 277575 - DNA, 634 bp, Homo sapiens
cttacccccatcctcacaccacctttgaggtaggaactgccatgatggatgcccatttcacagatgtggaaactgaggttctgacaggaaaagtaacttggccaaagtcccacagggatgaggtgagcctggacttgaatgcaggtcaggctccgccccgccaagtcccacaccaccttctctggggaaaggcagctctcacctgggcagcccctggaggcttctacccctagaggggaaaataggtctcacggcaagacagcagtccccaggtggatattcaggggccaggacagctctgtcggatctcaccaaccccaccagcgcccaggtgctgagaccgaggtgctgagaggctagaagagaacttcagccctgcctgacagagaaggttcagcctcactcccgctcaccactcactcaggcaagtcgctaaacatccccgagcctcaagtttcctcatctgcaaaatgggacaataatgacctccctcctagagtggttgggaaggttaaaccgcagggcgcatggagcacagctggtactgcaccaagtaccaagtaaacacgcatttgctgtgagcttgctgcttccgaataatctcattaaaaatattaagaattttgccagataa

SEQ ID NO: 277576 - DNA, 790 bp, Homo sapiens
cttacccccatcctcacaccacctttgaggtaggaactgccatgatggatgcccatttcacagatgtggaaactgaggttctgacaggaaaagtaacttggccaaagtcccacagggatgaggtgagcctggacttgaatgcagtggacgcgcggacaaacggacaggcgcgaggtggaggtggcgacgatgcgtccaggacccctgctggacacgcaagcctggaccgggactggaacacggacccgcacacacgcagcctggataggagatacacggacagagggacatatggatacagtcaggctccgccccgccaagtcccacaccaccttctctggggaaaggcagctctcacctgggcagcccctggaggcttctacccctagaggggaaaataggtctcacggcaagacagcagtccccaggtggatattcaggggccaggacagctctgtcggatctcaccaaccccaccagcgcccaggtgctgagaccgaggtgctgagaggctagaagagaacttcagccctgcctgacagagaaggttcagcctcactcccgctcaccactcactcaggcaagtcgctaaacatccccgagcctcaagtttcctcatctgcaaaatgggacaataatgacctccctcctagagtggttgggaaggttaaaccgcagggcgcatggagcacagctggtactgcaccaagtaccaagtaaacacgcatttgctgtgagcttgctgcttccgaataatctcattaaaaatattaagaattttgccagataa

SEQ ID NO: 277577 - DNA, 1233 bp, Homo sapiens
ctttattcaactttagttcaaagaagtgaccactcacatcacagaactctctgaggcatgctgggctaattgactctattgagatatcctttgttatgataaaaatcttctattcccctatacagatggtaccagccaagaggaaagtcactcgtgcctgtggtcaagcttcaggcaatcccagtgaccttgtgctgccttaactcacccctgtctcctgggaagaggtgcagaaggggaaagtgcttgggccttcctctcagtgacaccactcccctctttgtgtcactgccttgcttttgggctcagcgtcattaaagcactgctgcaccttagtgcacacactcctttctaggtcactgagacatgaagtgagtatcatttgtaatattcatacttttctctgtgaactggcagggggatggagaagggcaagaaagtgggagcagtgtctgctgggagggtggagaattaatttgcattaatttctcaccctgttaactggtgtgtcacttctctactcacacagcctccagtgtggatttagcaattacttagctcagcagagataatgtaccccataaaatggcagagacactggccagggctgggcccaggaattcagtatggataatattctaattctgtatgacaagctttaccataaatttgaatctgtaatttctgctttgatcaatttgatgtataaggagtggagccagtcaaatttggaaataaaatttcgaggttagaattccaattatgccggtgattcactgcataaaacatacgagcctcagtttcctttttcatctgaaataaaaggagattgactccaggatcttccaaggctgctattccaagagcaggttcataaaggtgattgtcaagctccagtgcaaatgctaataatctggaattttccttcaaaccatctgcctatgcaaaatacaactgggtcacactggaaaggagagagagagctctgattcatatgagaaatcaagaatcgaaccttcatcttgaagatataaaccttttgccatgtaaatgtgaaggaggaaaaaaatggaagagaatctacgattttaaaaggcatattttagtgggttacaatatgttataattgatatttcttactggcctaaaaacaacactaaaataatcctgaagagcagagtagctgtaaaaaaaaatcgcaataaaaaaatcctcccataataagctaaaatg

SEQ ID NO: 277578 - DNA, 1835 bp, Homo sapiens
  misc_feature (1029)..(1029): n is a, c, g, or t
ctttattcaactttagttcaaagaagtgaccactcacatcacagaactctctgaggcatgctgggctaattgactctattgagatatcctttgttatgataaaaatcttctattcccctatacagatggtaccagccaagaggaaagtcactcgtgcctgtggtcaagcttcaggcaatcccagtgaccttgtgctgccttaactcacccctgtctcctgggaagaggtgcagaaggggaaagtgcttgggccttcctctcagtgacaccactcccctctttgtgtcactgccttgcttttgggctcagcgtcattaaagcactgctgcaccttagtgcacacactcctttctaggtcactgagacatgaagtgagtatcatttgtaatattcatacttttctctgtgaactggcagggggatggagaagggcaagaaagtgggagcagtgtctgctgggagggtggagaattaatttgcattaatttctcaccctgttaactggtgtgtcacttctctactcacacagcctccagtgtggatttagcaattacttagctcagcagagataatgtaccccataaaatggcagagacactggccagggctgggcccaggaattcagtatggataatattctaattctgtatgacaaggtaaggcacaaacaagttagccatgtttttctctcaaaactatatatatcttactaggtatatcacagtgtattatatagacatacctatgtatgtttatatatttccataaagttttcttatcttatttttggtcttttcctttccactggactctaagcctcatgagggtaaaggttttgcctatttgttcactgttgtaactccagcacctagaacaatgtttgcccgatagtggacactctataagtatttgttgaatacctaaatccatattaagatcaactcttatgtttgaattagtctagaaatttgggggatgttggattatatgttccatttttaaaacaagatgtttataatcaagtgacangattttaaaagaacatcattttagttgaggtgccagtaaaattcgtgaatgctttatgctaaaaaaatattgggttacgtggcctcttaccttctgactcatcgttctgctttctttttcttagctttaccataaatttgaatctgtaatttctgctttgatcaatttgatgtataaggagtggagccagtcaaatttggaaataaaatttcgaggttagaattccaattatgccggtgattcactgcataaaacatacgagcctcagtttcctgtaagtgttcattttgctccaagccttcttttgagggaggatacacacgttgcccaaggcaccaagaataaaaactttcttcctgggctctttccctgtcatcagttttcatctgaaataaaaggagattgactccaggatcttccaaggctgctattccaagagcaggttcataaaggtgattgtcaagctccagtgcaaatgctaataatctggaattttccttcaaaccatctgcctatgcaaaatacaactgggtcacactggaaaggagagagagagctctgattcatatgagaaatcaagaatcgaaccttcatcttgaagatataaaccttttgccatgtaaatgtgaaggaggaaaaaaatggaagagaatctacgattttaaaaggcatattttagtgggttacaatatgttataattgatatttcttactggcctaaaaacaacactaaaataatcctgaagagcagagtagctgtaaaaaaaaatcgcaataaaaaaatcctcccataataagctaaaatg

SEQ ID NO: 277579 - DNA, 555 bp, Homo sapiens
ttcctatccaaataccaatgacttgaatcacattttctaggactgccacaaacaaaagatttatttggagacgaataaaaaggggccgtaggattacctacaaaaagttatttcctcctgagattgatggcacaaccttgtcagcaaattgctgttgcctctctcagttaccaaaaataacccgtaacaaacaccaggcttgggtgtaagttctttcctaagggaacaactcagcagagctgtttataactagagaggaggaaacaataatctgcaagatgtcgccaggtcggcaacgcgaactgactttgactgggggttcagctctgctcctgcgccgaggcgaggaccgcaggtttagcgcggtcccgcacacacctgccccgggcgggagggcaccgaggcgcgcgggacgcacgagagtcccgcccttcccgggtcgcccccgacccgggcagtcggatagggtcccgcacccgggccccacctcaccttcacgggcggaggcggcctggggaggccctctaaggcccccctcacgcccagcgcggccgc

SEQ ID NO: 277580 - DNA, 849 bp, Homo sapiens
ttcctatccaaataccaatgacttgaatcacattttctaggactgccacaaacaaaagatttatttggagacgaataaaaaggggccgtaggattacctacaaaaagttatttcctcctgagattgatggcacaaccttgtcagcaaattgctgttgcctctctcagttaccaaaaataacccgtaacaaacaccaggcttgggtgtaagttctttcctaagggaacaactcagcagagctgtttataactagagaggaggaaacaataatctgcaagatgtcgccagcagcagaatgagaacggttattagttaatagccatcagagacagaccaagtggaacacagtcctcggaaaaacgccactctgtagcattagtaattaaaacctcacaagacttctcagtcctttatgtggagctgggggcaggaagaattgcttctggaagctgatggagttggacatgtggctttctagaatctgtgcccagcttgtcaagaagttgaatcggtgcaaccagcgtttgtgaaagcagcatttcccatttcacataaagtcagcttctggccaactggacaagtctgaacaaatatgaaacccactaaaaggccagtgacaggtgcacacactactgactctggctagaggctgtggcaggaattggactcatgtcatccagcgacagttccaccagcatctcttgtggcttcccaaggaccagcctgaggcaaactcctcagtggtgtgaagactttccatgtcactggaaacccaccacagagttctaccaagtaaccatgcctccaccagtccacaacaaacttttaaggcctctccagttatgcctg

SEQ ID NO: 277581 - DNA, 3539 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277582 - DNA, 3371 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277583 - DNA, 3508 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggaggttgttgtgagccgagatcacgccatttcactccagtcagggcaacaagagcgaaactccatctca

SEQ ID NO: 277584 - DNA, 2263 bp, Homo sapiens
  misc_feature (37)..(37): n is a, c, g, or t
tgactcttgaggatcccctgtgcagtcagatttctgntagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277585 - DNA, 3923 bp, Homo sapiens
  misc_feature (3783)..(3786): n is a, c, g, or t
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccagctcttttaaaggatctgtcttctcaaggagcctagttggctatgcacaaggaaagcgccaaaagagctaaagggaggaagggaagagaaaacatttaactctcccatggtggttactgacccagcgtgggtgcggggagattgggatgggaagtccaggtctgggggcagccagcagttgtcagtttctcattgacagccctgctccttggagattgtttttgtgggtagtcttgtgtgtggcattggtggaatggctgaatctaggagacgcggcgtgtccagaacttgctggaaattggttttgagattttgggcaaggcctctcacccggagcctcagttccctccctaataaagcagggctgttataaggataagatgcaatcgtgagggggtgggaaaggactaagagctctgtaaaaatacaaaccaaatgctggtggtgcttccacacctgcggcatttggggtgggggtggtgacaacattgcccacactcaacccacacactcaggagttggggggggctggttcttaagacgagttggcttgcaaaggagtgaacttgagaaggacctgcgcctcgtgtatgtacatttgtttttggccaggcagaggcttacggtgaaaagcccaaggcccagctgacagtggacacaggggaatttgtttgtttgtttcaatccgcatctggagtgagtcattgccacttgtcatggtgaaatggcaaatctgggcttcctgtggttccagaagcctgcgactggaaatccacaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtgggtggaggcnnnnccctccaacctctattatcaccgcgagcctcgtggaattcaatcctaagaggaagggagggtgagggttcttataataaaaaattaatcgaggtttgatccccatttactttcttgagtgggggctcgtaccctatt

SEQ ID NO: 277586 - DNA, 1606 bp, Homo sapiens
ctggaagcttcacctgtgaataccaacggggattctcacttgatcagaccggctccagctgtgaagacgtggacgagtgtgagggttaccaccgctgcccgcatggctgccagtacatcattgggggctacaggtgcagctgcccccaggcgcatggcagcaacactcgggaaagcagggaacggacatttgcacaacgctagcttatctgtcggcagaagcccggatgcatatgggttcttcacctggccttgtagaggcaagagctgccccagtccctcgtagggagaatcttcctctctgggtctttgagcaatgacatctttcttgggttgatgacagctaacagtttgcctctgatatccctgcagtgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277587 - DNA, 2558 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaacttttgcatactcccctgctttgacatataaaatgattttgctttttgctgacatggttcaacacgg

SEQ ID NO: 277588 - DNA, 2358 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtatggccctgccccacacgacccgaactctccacaattattggggcaggacagggagaggatcctagagaaagctgtgtggggcctggagacctggtggggcaaggcaggaggcaggccccatcctggcctgaacgaggggtctaaccctgtcttgtctttgcttagtgactcgactcatctactccctgtatcctttgtctttcctctgagatgctctatcctgcttttctgcctttgctggggtcagaagtgttaatcccactgtacaggtgaagagactaagtctgggaaagacaaatagattcaatttttgtaaagcc

SEQ ID NO: 277589 - DNA, 1570 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccagctcttttaaaggatctgtcttctcaaggagcctagttggctatgcacaaggaaagcgccaaaagagctaaagggaggaagggaagagaaaacatttaactctcccatggtggttactgacccagcgtgggtgcggggagattgggatgggaagtccaggtctgggggcagccagcagttgtcagtttctcattgacagccctgctccttggagattgtttttgtgggtagtcttgtgtgtggcattggtggaatggctgaatctaggagacgcggcgtgtccagaacttgctggaaattggttttgagattttgggcaaggcctctcacccggagcctcagttccctccctaataaagcagggctgttataaggataagatgcaatcgtgagggggtgggaaaggactaagagctctgtaaaaatacaaaccaaatgctggtggtgcttccacacctgcggcatttggggtgggggtggtgacaacattgcccacactcaacccacacactcaggagttggggggggctggttcttaagacgagttggcttgcaaaggagtgaacttgagaaggacctgcgcctcgtgtatgtacatttgtttttggccaggcagaggcttacggtgaaaagcccaaggcccagctgacagtggacacaggggaatttgtttgtttgtttcaatccgcatctggagtgagtcattgccacttgtcatggtgaaatggcaaatctgggcttcctgtggttccagaagcctgcgactggaaatccacaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggtaagactcagcagcctggaatggggcaaagtgtttgtgtgggggaaggaacttaaaaatgagattcacccacatcagggtgctgtcttgcatgttctacagcacgt

SEQ ID NO: 277590 - DNA, 390 bp, Homo sapiens
caaaactaaatgtgtatgtcctaaaataagactatagtggacaatcttacattcgttaaatcaatttctgtttgctttcttctcttctctgtaggttttgagcaaaattttggactgtgaagcaaggcattgggtaagtaaataaaattatatgctttaaaatgttgggacaaactgtttcttttgaatttgccaatacatgtgtctctgtgaactttgccactgttcattatatgagacaaggataaccagttccctctacatcactcctagtcctcatccttcacctctgtattagactgtcttaccacttgcatggtcaatcattgttactctttctttgtacaaactaatttagccagctaatgttcaccaacaatatgctagctc

SEQ ID NO: 277591 - DNA, 4724 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccagctcttttaaaggatctgtcttctcaaggagcctagttggctatgcacaaggaaagcgccaaaagagctaaagggaggaagggaagagaaaacatttaactctcccatggtggttactgacccagcgtgggtgcggggagattgggatgggaagtccaggtctgggggcagccagcagttgtcagtttctcattgacagccctgctccttggagattgtttttgtgggtagtcttgtgtgtggcattggtggaatggctgaatctaggagacgcggcgtgtccagaacttgctggaaattggttttgagattttgggcaaggcctctcacccggagcctcagttccctccctaataaagcagggctgttataaggataagatgcaatcgtgagggggtgggaaaggactaagagctctgtaaaaatacaaaccaaatgctggtggtgcttccacacctgcggcatttggggtgggggtggtgacaacattgcccacactcaacccacacactcaggagttggggggggctggttcttaagacgagttggcttgcaaaggagtgaacttgagaaggacctgcgcctcgtgtatgtacatttgtttttggccaggcagaggcttacggtgaaaagcccaaggcccagctgacagtggacacaggggaatttgtttgtttgtttcaatccgcatctggagtgagtcattgccacttgtcatggtgaaatggcaaatctgggcttcctgtggttccagaagcctgcgactggaaatccacaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277592 - DNA, 4209 bp, Homo sapiens
tcccagctactcgggaggctgaggcaagagaatcgcttgaacccgggaggcggaggttacagtcggctgagatcgcgccactgcactccagcctgggcaacagagtgagactctgtgtcaaaaacaaaaacaaaatttaaatttaaatttaaaaagaccctatctatacagaaagaaaagaagaaaatacaaaccaaatgctggtggtgcttccacacctgcggcatttggggtgggggtggtgacaacattgcccacactcaacccacacactcaggagttggggggggctggttcttaagacgagttggcttgcaaaggagtgaacttgagaaggacctgcgcctcgtgtatgtacatttgtttttggccaggcagaggcttacggtgaaaagcccaaggcccagctgacagtggacacaggggaatttgtttgtttgtttcaatccgcatctggagtgagtcattgccacttgtcatggtgaaatggcaaatctgggcttcctgtggttccagaagcctgcgactggaaatccacaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277593 - DNA, 3477 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277594 - DNA, 3021 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacaccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277595 - DNA, 1591 bp, Homo sapiens
actccgaccccaccgcaggttgtactggccccacgttccctgaggagatgggagagacccagtctgagtactcagattctagctgtggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277596 - DNA, 1942 bp, Homo sapiens
caagggaaaagctagaagaaccttcccaggtaatctgaagtagcccctcaggttccagagagggaaactgaggcccagagaaggagagtgacttgtccaggttccgcaggcagataatcctaatgacaaagctggttctaaagcccaggcttcctggaatctccccctctcctatcccacacctggcattgttgctactccgtgccaccacttgtttcttggccctggtcccctgcgaggtatgcaggtgcgtgtgtgagagagggctgacagatgtgggggcaggcccctggattctctctctcacattccctaagggaaaggaaaacacaagtggcctcagggaggagcaggctgcttagaaatccaggagccacggactgcagagaccttccttattgaatatggcttttctttttccctttttcttggtaataggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277597 - DNA, 2569 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaat

SEQ ID NO: 277598 - DNA, 2771 bp, Homo sapiens
ggcccctcgagcctcgaaccggaacctccaaatccgagacgctctgcttatgaggacctcgaaatatgccggccagtgaaaaaatcttatggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccatgtacgtaagcctcttgaggccgctctctgacctgcggggatgtggagggcagggaaggaggtggagcgcagggaaggaggtggagcagggaggcagtggaactgtttgctcccatctcaagcacacagtggggcaaccactacgctaatggttggaagacctagatctgggcccaatggccagacaccctgcttgaccttgtcccaagcattaggggactcatctttaaaatgagggtatgggactaggtgatctgggccttaggagaggagtctagactgtggatacatagacttgattcactccacctagattcattcatttcacaaatacttattgattgcctcctggacaccccatactgggctagatgcacatttaagaggagctaaggtgtttgagaaggaacagtcttaggaggaggagaacaaaaagaatgttataagaattaatgatgttacaggaaa

SEQ ID NO: 277599 - DNA, 489 bp, Homo sapiens
agttggttagtttcacaagaaatgccagtaaaagtttaataaggaacatcttccatattcagcaggaacaaggaacaagactacaacacaagcactgaatgaaacagaaaagcatgctcacggcagatgcttattccattcatgttaacatttaacacatctgttaaacagggtgctctaagccctatttttgacagtgactaaaaatgatgtattctaactaggataagtagaaatcaagggaaaagaggttgaatctgaatacacaaatttatatagctcattcctagaacactacactgtcctgtgttttcgataaattaactatacatatgcattttacttcaagatagggaaaagcagaagtttaatgatttttttttttacaattgttgtcaaagctgtttggatttttaaatgtaaatactgaggactaagaaatcttgttaagaagcagggtcgacgcggccgcgaatttagtagtagtag

SEQ ID NO: 277600 - DNA, 506 bp, Homo sapiens
cagacgggaaggaactaacatattcaagcttacttctggctgtgtcactgacccaacagaggccagtaggtccagcatggcaagcatggctccaggatgaatgatgactgcatcagaactctgcagagatgaagttgtcacatgtagtttcaggtctgagaagcagccaagaaatcgaacagcatctgccaacttctcatactgaatctctgttttgaagaaatgagagttggctggctcatagcgcattgctgcagtcaacgtgcagaacacagtgtgaagaagttcaaacacttgattctggttcactttctcccagccattcttgggtggacagctcaaagatctttccatagcaacgagcaaggatgtaatgtacacaaatcctccaactttcctaaaaactgttcttgaacgatggctttctcgaaggaccgacaggagggcctacaggagacaaaagaaaaaacaaatgaaaatacacataattcaaaaaaaaaaaaaaa

SEQ ID NO: 277601 - DNA, 1923 bp, Homo sapiens
agttggttagtttcacaagaaatgccagtaaaagtttaataaggaacatcttccatattcagcaggaacaaggaacaagactacaacacaagcactgaatgaaacagaaaagcatgctcacggcagatgcttattccattcatgttaacatttaacacatctgttaaacagggtgctctaagccctatttttgacagtgactaaaaatgatgtattctaactaggataagtagaaatcaagggaaaagaggttgaatctgaatacacaaatttatatagctcattcctagaacactacactgtcctgtgttttcgataaattaactatacatatgcattttacttcaagatagggaaaagcagaagtttaatgatttttttttttacaattgttgtcaaagctgtttggatttttaaatgtaaatactgaggactaagaaatcttgttaagaagcaggaaatatctcagttgatacttcaaagcagatattccacagaaaaggacacaaaacctattacaagctctatccaatgtagttacatggtctattgatgagggcagttcatttattttatgtagtaaaactatggtaagttaaaagcaataacacttggggcataaattagaagtattattttcaaagtgacatcttcattgaaaacacagttgaagcactgaaaataagtgatctagatgaagtggctctcctacaatctgcctgagaaccctggattcccccactgtagaatgtgtcacactatatgtaattgtttatttatgtgtctacattttagctaaaagatagcaaggaccaagacagccctgtgtagagctgaatcctcaatgcctagcacagtgacttggcatgcagcagctttttgttaagtacttatttcatgaaggaatgagtaaatattgagtctgatggcctcttgaacttgacggttcaagacactgacacctctctttgggaactatatcattttttgaggagtatgatatgtggagaatgatggagtacgtgtctggaaataagaataatcataatgatgttctattgataacacatatcaataagtccagatgcaccttttgaggctaaaaagaaaaaaaacaacagtaaacactatcattaaaggaaacttcatagaaactgttccaataactgcaatgagaactaattgaacctgaatttacaaatagtacacaggcttccatgctaaaaaaaaaaaaaaacaataccagagcaagagtaatattcaaaaataaagtgatacacttcaaacaaataggagaagagtcatctgttttcatattcttttggattaactcataattcaagtcttaatgttgaagtcatgcttagtatacaccctttaattcagaggacagagcagagccatacctgtcaaaagaatctgtggctactttgtaaagataaataaaaagtttactgcagtgccgtaacgtgggtgacactgattctattgagattacatcttcctctaaaagtctttgaaatggctgtgtatttgaggggaagacattcatggcgcttatttttcttaggtctgagaagcagccaagaaatcgaacagcatctgccaacttctcatactgaatctctgttttgaagaaatgagagttggctggctcatagcgcattgctgcagtcaacgtgcagaacacagtgtgaagaagttcaaacacttgattctggttcactttctcccagccattcttgggtggacagctcaaagatctttccatagcaacgagcaaggatgtaatgtacacaaatcctccaactttcctaaaaactgttcttgaacgatggctttctcgaaggaccgacaggagggcctacaggagacaaaagaaaaaacaaatgaaaatacacataattcaaaaaaaaaaaaaaa

SEQ ID NO: 277602 - DNA, 1085 bp, Homo sapiens
ggagcgagccagcatgtggtacacccgggacagcgtgtccaggaagcccaggtggcccgaggaggtggcagacagcacacggaggccatcggggctgacacagactgagctgacggggccctcgtgctctgtgggtggggtggggtcaggggcctccagggccaccccggggtgagccgcatgctcaggcttcgggtccccgacaccccagcaaatgcactccctgctgctcaaagtcccaggctccacacggctgcaagatgcagctccctcgaggccaccactcttaggctaggcgggacccaggctgaggggcttcacacactacccacgtcccaccgggcccttccgtgaggctgccctgcgggccgccctggcatcagccgccccagggctctggatatgccacttggccccgttggcaccctgtgcagccaggagccagggcggctgacagcagagccccggggactgggccttccccgccccagcatccaggcgaggctctcccggagttgggagagcgtgcccacagcatcacctgcctccaggagcaccgaggagaagtccaggggccagagccgcaagaagccgtcctcagagcccacagcacacatggccggggagacgctgaggctgctgatggcaatgccggggcctgggggcagggaggcgtcagtgcctcggtgtccctgccaccctggccacgtggtgggcgccctcttacctgagctgaaggtctgcttctgtgggtggggaccgcctggagtccgtgtggggagcaggcggcgggcatgccgcacgaccatgcgctgacagtcaatctccaagatgtggccactgcggctgcacacgaagctgcccgaggaggcggcagggaagtccacggggcaggaacgcagcaccccgccacgcagccgccagagccgcacactgccctgcccgcacgacgccatcctgcaaggaatgaggactgagcactgccgcagctcgcagcgccctgacccaccgggagacgcagagacgcacagccaagccagggggaggtgctcgggcctcggcccccactccgggcccagaccctc

SEQ ID NO: 277603 - DNA, 471 bp, Homo sapiens
agatctaccaattaggaaattagctgtgatttagaaaatttaatatttcgatgccatactttcctaatctgcaaaatttttgtaaatacctgtgacctagtgtcgtgagcgcttagcaacacctgacacccactaagctctcagccagtggttctgaaagtggttctagaccagcaacaacagcagtagcagcagcacctgtgaacttgttagaaatgcaaagtttcaggcccattccagttctactgaatctgaaactcgaagggaacagcaacctatgttttaataaaccccaagatggtcgccagagaaccatgatgacaaagaggatcatggagaacagcaagcgccagatggcatcgtctacccacagctcccgccagtcctacaatacaggggagaagtacaacattcatacacattatcttaaccccttgttcataaagcctttggcatagaacaaaaatcaaa

SEQ ID NO: 277604 - DNA, 464 bp, Homo sapiens
agatctaccaattaggaaattagctgtgatttagaaaatttaatatttcgatgccatactttcctaatctgcaaaatttttgtaaatacctgtgacctagtgtcgtgagcgcttagcaacacctgacacccactaagctctcagccagtggttctgaaagtggttctagaccagcaacaacagcagtagcagcagcacctgtgaacttgttagaaatgcaaagtttcaggcccattccagttctactgaatctgaaactcgaagggaacagcaacctatgttttaataaaccccaagaactatggctccttaactcagaagggcccttttttctcaaaacaacctctgcaagatgtaaccttgacttcccaggaaaatgaaaggtagttaacaatttcccccatcacctatgtaactccctaaataaataaaaattacaggcagttgctcctggagattacata

SEQ ID NO: 277605 - DNA, 633 bp, Homo sapiens
agatctaccaattaggaaattagctgtgatttagaaaatttaatatttcgatgccatactttcctaatctgcaaaatttttgtaaatacctgtgacctagtgtcgtgagcgcttagcaacacctgacacccactaagctctcagccagtggttctgaaagtggttctagaccagcaacaacagcagtagcagcagcacctgtgaacttgttagaaatgcaaagtttcaggcccattccagttctactgaatctgaaactcgaagggaacagcaacctatgttttaataaaccccaaggtgtatacccagtgacatgaatcctggatcataagaagagagaccgaacaccaggaaagaaaatacagatttccccagactctacctgctatcaccattttgttgtaatacaccttaactcagagtaaacagaagagtccaagaacctctggttgtttgcagatggtcgccagagaaccatgatgacaaagaggatcatggagaacagcaagcgccagatggcatcgtctacccacagctcccgccagtcctacaatacaggggagaagtacaacattcatacacattatcttaaccccttgttcataaagcctttggcatagaacaaaaatcaaa

SEQ ID NO: 277606 - DNA, 699 bp, Homo sapiens
agatctaccaattaggaaattagctgtgatttagaaaatttaatatttcgatgccatactttcctaatctgcaaaatttttgtaaatacctgtgacctagtgtcgtgagcgcttagcaacacctgacacccactaagctctcagccagtggttctgaaagtggttctagaccagcaacaacagcagtagcagcagcacctgtgaacttgttagaaatgcaaagtttcaggcccattccagttctactgaatctgaaactcgaagggaacagcaacctatgttttaataaaccccaaggtgtatacccagtgacatgaatcctggatcataagacagaaacaatgtgttactacatttttgttgctggggaaaagaactgacttgatgtacttcctcagaagagagaccgaacaccaggaaagaaaatacagatttccccagactctacctgctatcaccattttgttgtaatacaccttaactcagagtaaacagaagagtccaagaacctctggttgtttgcagatggtcgccagagaaccatgatgacaaagaggatcatggagaacagcaagcgccagatggcatcgtctacccacagctcccgccagtcctacaatacaggggagaagtacaacattcatacacattatcttaaccccttgttcataaagcctttggcatagaacaaaaatcaaa

SEQ ID NO: 277607 - DNA, 626 bp, Homo sapiens
atattaagagtaatgttctttcaaacgctaatatttgcatgggaagttggaatatacagtgggaaagcttgacatattgcttttcttataaaattggaaagtattagcaatgcgtaagtgtgcatttatttgttcagaaaatttgtcagaaacctacgatgtacaaaacacaaacatggttcctaaactctgtcatgaaagaatggtatattagtaacatttgagtcataatttagaaggttttatgattatgacagtccatgaactcttaagaatattttaaaatgttctttaaaatgattgactctaatttgtaactagaagaatgcttgaaatgatttttcacccctgtctgtatttaaaggtctcagaacctcaggatctccagcgttgtccttactgatcattctttatgtgaaactctctctttttgtggtcattctggtcaccacaggatttgttttcttccagaggataaatcatgtcaggtaggaatatttattaagcggaagtaaatcatcataaaggtcttcatccttgttgtcttcacattgagtagactcaaataagagctatctggctgggaggagccaagatggccgaacaggaacagctccggtctacag

SEQ ID NO: 277608 - DNA, 470 bp, Homo sapiens
gtctactgtgacctgccatgtctcccatttgactggcaacaagagtctgtccgtaaagtttgaattcaggtctcagaacctcaggatctccagcgttgtccttactgatcattctttatgtgaaactctctctttttgtggtcattctggtcaccacaggatttgttttcttccagaggataaatcatgtcaggtaggaaaaaagttctttaaagaagaaggaagggtcttcttttgcttctcctccttgtctctggactgcaacattggtgagatgagtgatggtccagcagtgaacttgggccatggatgatgttaaggatagaagccactcagtaggatagaagaaaagaaagatggaagaaggatcctgggcttgatgaccatgaagtttccctataaaccctcaaccacctattcattgacttcttttgtgttagagtgaataaaattttgttcatgccagtgtt

SEQ ID NO: 277609 - DNA, 850 bp, Homo sapiens
gggaaacgggagggagacagaatttaaataagtaatatctcatcagatccatttgatttttaactagcgaagaaaaagtcattttccagatatggtgagggagagaattttttttaactctgcgactacttcgtaaagcccaaggtcatgatgtagcatattcacactctaaacgtgagtttcccctgcagaaaataatctacaccaacccataattattctttacgatgatccaccttttataatgtagatgtttaaaataaaaaccaaaggaatgaccaatgagagccacagtccctaggaagaactgtaaatgaagacgaatccacatggcacaggatttctcccaacatcctcaaacgggaatcatccgaaggcatcgattctacagcccaaagcctttgtccacaactcccaggggtcagagcttccttctttcgcgccaggccaaagttgctacgtgggatccgatgttgtcgccagactttcagccaaaatcagccttcaaattaacctggaccgcccaacctccgtgcctttccgttacgccgtctcaagggcaaacattccaccctaactcgccagagggtgaactgcccccagatctaactgaaaacacttgcccttctcaagcctaacgagctgggcctgcagcgcttttctgccaccactgactacgatgacatagcaaagaaaaaaatatacctatgaaatccttcgagatcttcactctcaagatccctgggaagcgcacatacaccaccacatggaagctgacgggaaaggaagagtcggtgttttagcaagaaaagagggtgccctaacggcaggagctacgctagatactggc

SEQ ID NO: 277610 - DNA, 2065 bp, Homo sapiens
  misc_feature (12)..(12): n is a, c, g, or t
  misc_feature (17)..(17): n is a, c, g, or t
  misc_feature (19)..(19): n is a, c, g, or t
  misc_feature (28)..(28): n is a, c, g, or t
atgattcctcgncattntnggccccctngatccatttgttctcaagaggtagaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagagacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaa

SEQ ID NO: 277611 - DNA, 1970 bp, Homo sapiens
tctagaggatccgccaagaggtagaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagagacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggagaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaa

SEQ ID NO: 277612 - DNA, 1236 bp, Homo sapiens
  misc_feature (1)..(1): n is a, c, g, or t
  misc_feature (3)..(5): n is a, c, g, or t
  misc_feature (180)..(180): n is a, c, g, or t
ngnnngaggtaaaaagagactgtaaaagatagcaataatttttataatacatgttgaaataacattttgagaatattgagttaaataaaatatataattaaagttaattttactagtttctttctactttttaaatgtgactactagaaaatttaaaaatatataagtggctcacattcntgactcagattacattcatcattcatactggacagtgctgggctaggcagtcaccacaggaaagcagaaagggcatctctcaagggttgcataccttcctggtccaataagaatatgagagtcaaatgcagcttctacttctcccaggcatttcaaattagtgccttgctgtgtgatagtgagttctttgctcaacccctctggactctcaccatttcatcccattctttattccccagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgatggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaa

SEQ ID NO: 277613 - DNA, 827 bp, Homo sapiens
  misc_feature (1)..(1): n is a, c, g, or t
  misc_feature (3)..(5): n is a, c, g, or t
  misc_feature (180)..(180): n is a, c, g, or t
ngnnngaggtaaaaagagactgtaaaagatagcaataatttttataatacatgttgaaataacattttgagaatattgagttaaataaaatatataattaaagttaattttactagtttctttctactttttaaatgtgactactagaaaatttaaaaatatataagtggctcacattcntgactcagattacattcatcattcatactggacagtgctgggctaggcagtcaccacaggaaagcagaaagggcatctctcaagggttgcataccttcctggtccaataagaatatgagagtcaaatgcagcttctacttctcccaggcatttcaaattagtgccttgctgtgtgatagtgagttctttgctcaacccctctggactctcaccatttcatcccattctttattccccagaccaactccaggctgataggaaaaaagatgaaaacagattcttcaaaagcatgaataaaaatgacatgaagagctgtaagtgagaaatgatggttggttgcttctgccatttggggaaagtgagaaaaggggaagaattgtgtctctatgattacatgaaggccagatataagtgaatgccgattcctcagcccattgagagaacaggcatatggttgttttattattttaaactcaggtaactcacaaaacagtcactaatcccaaactttgaagtattcagaagtaatagaaaattacaaatgtatttcttcactcctagagacagggaggaaaaagtgggacaagaaggaggcagctccacctctgtagtatttgctgcccctacagggcaccaggtttcgaggc

SEQ ID NO: 277614 - DNA, 430 bp, Homo sapiens
aacgttccccaaccaccgtccgagctgccccactcttcgcccggtcactgatgcagaggctgtcaggcctctctgcgcacgaaacccatcacagcacctgggccagcagccagtgccgggctgtcctcttcccaccccaaggcggtcctcttgagtctccacaccgcctctttcggatccgtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaa

SEQ ID NO: 277615 - DNA, 796 bp, Homo sapiens
  misc_feature (1)..(1): n is a, c, g, or t
  misc_feature (3)..(5): n is a, c, g, or t
  misc_feature (180)..(180): n is a, c, g, or t
ngnnngaggtaaaaagagactgtaaaagatagcaataatttttataatacatgttgaaataacattttgagaatattgagttaaataaaatatataattaaagttaattttactagtttctttctactttttaaatgtgactactagaaaatttaaaaatatataagtggctcacattcntgactcagattacattcatcattcatactggacagtgctgggctaggcagtcaccacaggaaagcagaaagggcatctctcaagggttgcataccttcctggtccaataagaatatgagagtcaaatgcagcttctacttctcccaggcatttcaaattagtgccttgctgtgtgatagtgagttctttgctcaacccctctggactctcaccatttcatcccattctttattccccagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggtaagagtcctgtctctgaatactaagggacctctaagtctacaggtggtcaaaatgctgtatccacccaattccactaaatggaataaatgaataaatgaatgaattcatttattccatttcctcagttcctccccaaattacacctctgccaggaaacagagggcgctccgacttgttcaggtgtactttcttgagtttcacctccatccctcctgctgtatgtagagctcagc

SEQ ID NO: 277616 - DNA, 202 bp, Homo sapiens
gcatggtggcacagccctgtaatcccagctacttgggaggctgaggcaggagaatcgcttgaacctgggaggcggaggttgcagtgagctgagattgcaccactgctcactccactgaaatggaactgtgactcatacatgccaacaatccctgggcccttctagtgccaggcttctggctgagtactttccacgcatcagt

SEQ ID NO: 277617 - DNA, 1839 bp, Homo sapiens
  misc_feature (12)..(12): n is a, c, g, or t
  misc_feature (17)..(17): n is a, c, g, or t
  misc_feature (19)..(19): n is a, c, g, or t
  misc_feature (28)..(28): n is a, c, g, or t
atgattcctcgncattntnggccccctngatccatttgttctcaagaggtagaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagagacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgatggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaa

SEQ ID NO: 277618 - DNA, 1430 bp, Homo sapiens
  misc_feature (12)..(12): n is a, c, g, or t
  misc_feature (17)..(17): n is a, c, g, or t
  misc_feature (19)..(19): n is a, c, g, or t
  misc_feature (28)..(28): n is a, c, g, or t
atgattcctcgncattntnggccccctngatccatttgttctcaagaggtagaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagagacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctgtaagtgagaaatgatggttggttgcttctgccatttggggaaagtgagaaaaggggaagaattgtgtctctatgattacatgaaggccagatataagtgaatgccgattcctcagcccattgagagaacaggcatatggttgttttattattttaaactcaggtaactcacaaaacagtcactaatcccaaactttgaagtattcagaagtaatagaaaattacaaatgtatttcttcactcctagagacagggaggaaaaagtgggacaagaaggaggcagctccacctctgtagtatttgctgcccctacagggcaccaggtttcgaggc

SEQ ID NO: 277619 - DNA, 2053 bp, Homo sapiens
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagagacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaa

SEQ ID NO: 277620 - DNA, 2017 bp, Homo sapiens
  misc_feature (12)..(12): n is a, c, g, or t
  misc_feature (17)..(17): n is a, c, g, or t
  misc_feature (19)..(19): n is a, c, g, or t
  misc_feature (28)..(28): n is a, c, g, or t
atgattcctcgncattntnggccccctngatccatttgttctcaagaggtagaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagagacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggagccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaa

SEQ ID NO: 277621 - DNA, 1448 bp, Homo sapiens
  misc_feature (12)..(12): n is a, c, g, or t
  misc_feature (17)..(17): n is a, c, g, or t
  misc_feature (19)..(19): n is a, c, g, or t
  misc_feature (28)..(28): n is a, c, g, or t
atgattcctcgncattntnggccccctngatccatttgttctcaagaggtagaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagagacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcaggtatgatgggccaccccaaatgtattttgcctactgattcatccacatacaattctcagcgtatatccaaatgcagtcaacattcctctctcagaaatacccacccacctctaactctgcattcatacatttaggctgcagctggggaatgcctatgccaaccatattagcacgtggttggttgttaaagaaaccagctgttttctcagccttcctccttcttcagcacagattctactatttcctgaatgcccccttgctcaactgaatagctcctgggtcccctactctgtctccctgaccctgtttttttccctcctctctgtctccatctcccatcttcatttccatatctccctatgccctacctcactcctgccccatatccctagccctgactttctgactcccagctcactatcccttaaccgccaggtcttcttctttttttttttttttttgagatggagctttgctcttgttgctcaggctggagtgcagtggtgcaatctcagctcactgcaacctttgtctcccaggtt

SEQ ID NO: 277622 - DNA, 1070 bp, Homo sapiens
attacacattcaaagtatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagagacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggtaagaaaaactccatcccacgatctctggaagcagaaacatctctgccaaagctcctggaatcccctattacactgacccctcagaaaaagatccagtgagccatgtcctctcctctgcgcctcagcacctgaccggccaggcggcatcacctcccgcgtcggcctcgctattacagcgggctgactgctcagtctccaccggcagacaaggtggggcacggaaaacccgcgctggtcttagaatcgcaagtacaggtttttaaggccgagctgcgccctcaacggattccccagttagaaaatgaagacattggccgggcgcggtggctcacgccagtaatcacagcactctgggaggctgaggatcgcttgagcccaggagtttgagaccagcctgggcaacatagcgagactctcctcttaattaa

SEQ ID NO: 277623 - DNA, 357 bp, Homo sapiens
ctcaaccccatatctcagatcctccttctcccacacctcatcccctgatctcaccaaccagctcaaccacatcttcctagaagtgaagagtttcagtttctcaacccaacccctgttcctctggaactggagaaaaaactcagtgaagcaaaatcaagacacgactccatcacagggagcctgaaaaaattcaaaggtaaggaagaggctgtattttctctattcacctacttccaggagattctctccctgctcactccactgaaatggaactgtgactcatacatgccaacaatccctgggcccttctagtgccaggcttctggctgagtactttccacgcatcagtatgcctcc

SEQ ID NO: 277624 - DNA, 927 bp, Homo sapiens
aacgttccccaaccaccgtccgagctgccccactcttcgcccggtcactgatgcagaggctgtcaggcctctctgcgcacgaaacccatcacagcacctgggccagcagccagtgccgggctgtcctcttcccaccccaaggcggtcctcttgagtctccacaccgcctctttcggatccctcctcatcctgaggacttcaggttgccggctcctcacttgggtcctgcgcacctcgggcttctcacagagtagccgtctccattctacggatagggaaacagaggaccagagccccgaaagtcgtacgccccaaagcccctgagagtggtctccaaatgctagtgctgtggctctggaaagattcattttatttcctgcaacaaaggcagcctcagagaactggcctccgagccttttccgtgcagacccccaatctttcaagacaccacagaccaattcagttggcaaaagccctaagaacagtacaccccaaaccaatggaataaaaaagtttgtttagttgagactgcagaactcttagctggcttacagatttctaaggcagcatttggcacctctgtttgctgtttggctcctctttcggcctctagagctgactgcagatccaatctccttgtcacatcctggtctgcaaactgagacctcacaggggcctttacaccgtagggcaactccttatgccgttgtcacactgaagctagaattctcaaagctggagcacttaggtgtctgcattttagaggtcccagcctgaatatatgcacaagcagggttttgttctgagctcagtgaagaggactgctgtgactccagctcttctgacatattagatgtgtaaaatgcaagattctcttccagccttgactggaggtgatgtggcaatgtgtgtacgcaagaaaagtcc

SEQ ID NO: 277625 - DNA, 524 bp, Homo sapiens
ctcaccaaccagctcaaccacatcttcctagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggtaagagtcctgtctctgaatactaagggacctctaagtctacaggtggtcaaaatgctgtatccacccaattccactaaatggaataaatgaataaatgaatgaattcatttattccatttcctcagttcctccccaaattacacctctgccaggaaacagagggcgctccgacttgttcaggtgtactttcttgagtttcacctccatccctcctgctgtatgtagagctcagc

SEQ ID NO: 277626 - DNA, 1617 bp, Homo sapiens
ggaatggaaaggatgtgaaaatttgactcagaaggtttgggctcaagcccagtcttgtgagtttactgtacaacctgcaaggaatcactttacctctctgagcctcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaa

SEQ ID NO: 277627 - DNA, 643 bp, Homo sapiens
cagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaagactgtggccaaaaacgacagctatttgattctgactgtgtcagggatccacttcttaatcctaacatggtgaaaaatagggatcgacagcaagcaatccttaagggactttcagaactgagacagggccttctccagaagcaaaaggagttggaaagtagtctcctgcctttagctgaaaatcaagaagagagttttggttcttcattttaaatgtagaaaatcaaatccttcacatttgatttgtgtcttccaaattataaaatgtgctcactggctcaactgtatttttcaaatagcctagatttacttatttttttaaatgctcattaaaaacttgtatactatgtagtaaaatgctgtacttgttctatacaataaaacagatacttcttttgtaaaagcttagtagtaaaaaaa

SEQ ID NO: 277628 - DNA, 604 bp, Homo sapiens
ttgtctgggccttcaacccaggaccctcagtaccaaaattcacaaggtaagtaaatattaagcattctaactgtaaaaattgaagacccatgtaaaccccgtcaacaactttaaattccaaattagtaattcctgcacttagttctataaagtttcttgaatatgtcttaaatttttcttagtactttcctaggatacatacttattataatgactcctgacaatattatatagcacagggctatgtcattttactaatgtaattgactgacttgttactttcatctggctttagactgtggccaaaaacgacagctatttgattctgactgtgtcagggatccacttcttaatcctaacatggtgaaaaatagggatcgacagcaagcaatccttaagggactttcagaactgagacaggtatgagctttttcaagtgtagatatgtctgttctttatgtggcgtgggcggttgggggaacctgttgaacggtttgttttaagttacttcggtgcatcccaggatttaacaaaaatatttcagttcctgtatgtttgttagacacaaataaaatgggactttcctaagacttgcttttacact

SEQ ID NO: 277629 - DNA, 479 bp, Homo sapiens
cagaacccaacaaactcaaaatacattacatttaccactaaaaaacagtagctatgagagagagaatttgatctcaggaagtaatcaaacagaattatcatctgggatttctgaatcatcccattttattccgtatgttcgaacaaatgagatctattaccttgatcccgatgcaccattgtctgggccttcaacccaggaccctcagtaccaaaattcacaagactgtggccaaaaacgacagctatttgattctgactgtgtcagggatccacttcttaatcctaacatggtgaaaaatagggatcgacagcaagcaatccttaagggactttcagaactgagacaggtatgagctttttcaagtgtagatatgtctgttctttatgtggcgtgggcggttgggggaacctgttgaacggtttgttttaagttacttcggtgcatcccaggatttaacaaaaatatttcagttcctg

SEQ ID NO: 277630 - DNA, 1368 bp, Homo sapiens
ttgaccacaatgcaggctgcatcttagacagggtctcactctgtcgcccaagctggagtgcagcagtgctatcacagctcactgcagcctcgaactcccggggtcaagcaatcctccctcagcttcccgtttctgaggttacagcccaaagtctcctcagcaacacttcctgtgagactacaggaatgaagggtgcctgtgtgatcagtcagatcaatcagcacatggaaactgagaaagacagatttaaagtccaaggagtttttgttgcaagttgtgcacatgttagatgcttcatttacaatataaccacagctggaactgaaaagaaacaaagacaatgataaaatgtgatgccctaagctacaaatttcatctgtagcagaaaaagaattgtcactaaaaactctacgacagtgtgtggaaaacttactgagtgttcagtgctatgcggtctacaagacagtcgtaaaaaacagtaaaacacactttctacgcagccattctcaggagtcatctgaaactgcgtacaccagtcctctgcctgccctccttccctccctctgccaagccctcgaggtccatcccagtctcatttccttgctggggccctcccttctcgtatcccagcctgcagcctttctctcttggaacagcagcagagtgcacgcctcaggactgactggtgctgttgcatcagctccttattctcacctccctggctgggagttctgagggcaggaactgtgtcttgtgcctggaaagcacgagttcaacagctgctcactggatgggcctgcacggggccttctctacaaatacagaaagccttgcaaggctggccgggtagcacccagatgctattaacactgctggtgatacactctcctctctttcagtgatttatgctattccatatttctgaagcaagccttactttagcaattttaaacagggaaactaattcaaatttctcaaataggggaaatgaactgaagatagtggtttcttatctagccacagatcacttggtctagcaaattttagatgcttttcctcagatatcaataataaatgtacaggaaaaaaattagtttttcaatttttgaaaactatttttcaaaaaatgaatacaaggccttacacagcatcctccacattacttttttcaactttaataccacatcataaaatgttttaaaaattcagaggtcaatatcttgactgtggcaatagatacacaaacttacaagtgtgataaaactaatgagaacacacacacacgactgcatgtgaacctggaggaatctgaatacgaccagtggattgaatggtgttgatatcctggctgtgacatggtactatcac

SEQ ID NO: 277631 - DNA, 626 bp, Homo sapiens
actgtggggctctggggaagaggaaatcacagatgaaacttcttcctggaagtaacttcacatcaatgtttaacacacaggtctgctgtcccgaccttcctgaggaggcaggaaatgcacacgggcaaagggacaagaatgaggatttcagacgcaaggaatggggatggcaaacttgtaggccaggtgccagggcagggcagccacaggccccctcaggatatagggaggaggccaatggaaggggctgccctgcaggttcaagggaggagcatgaaggcagtggtggaaggaaggtcttgccagaggggagagcagaaactgtaagggacccaggctcagagggacccatgaccaccatggctgtggtgcacaggtgagggtgagatggaggcaaggtccactgcctttgaggaaggctcaacatggacaaggtgggggcaagggagacttggctgtgaggcaggaggggcaggtaggctgtggtgccagagacgttttctacgaggtccgtatcccagggagaagcaatggtgtgggcttcagagtggcatggcaatgccccaagtagggaggtggatggaccagttggtgtcccctggggtgggctggtggcaagggtctta

SEQ ID NO: 277632 - DNA, 160 bp, Homo sapiens
tctctggaaaagtgaacgtaaaataaatgactaaaatcatgactaacctgaagctatagcgaagaacaactttacctcatggcatctcaatcttttatcagtaaagaggggtccatgataacgtgtcctacctacctcacaagacaaaataaccacgtca

SEQ ID NO: 277633 - DNA, 2063 bp, Homo sapiens
gcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 277634 - DNA, 339 bp, Homo sapiens
  misc_feature (320)..(320): n is a, c, g, or t
tatccacaacatgtctgtcaaggccatgaggtttcctcccaaatcgtacaacaaggacttgaagtctcgtttcacagctctgtgaatctggacgaatttgagtctcatcgaatcctccgcttgcaaccacctcagggcgagctgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaancaataaaaagttctccaca

SEQ ID NO: 277635 - DNA, 1698 bp, Homo sapiens
gcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagaggcctaacatcgtgtcccagctcagccaagcctgcgatggagccataacgagtcgtccagggcgtcttctcgtccacccagctctgtaaggggaaggaaataaactaagatgaaggggtctgaaaggatgattgacagggacctaagtctttcata

SEQ ID NO: 277636 - DNA, 1468 bp, Homo sapiens
gcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagcggtggagcagggatcctctagatca

SEQ ID NO: 277637 - DNA, 2211 bp, Homo sapiens
gcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgctgggcgtggtggcgggcgcctgtaatcccatctactcgggaagctgaggcttgagaatcgcttgaatccaagaggcagaggttgcagtgagccgagatccggacaccgcactccagcctgggagacagagcgagactccctctcgggcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 277638 - DNA, 2084 bp, Homo sapiens
gcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatggtaaccagtggcgggaggcggcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 277639 - DNA, 1931 bp, Homo sapiens
gcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 277640 - DNA, 1218 bp, Homo sapiens
gcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 277641 - DNA, 262 bp, Homo sapiens
catggccgtcatttcattcacatcagacacagcggcctctatttggtggtcacaacttcagaaaacgtttctcccttcagcctcctagaactgctctccaggtgaggagggttgggctgggcacctggtagctaggaggggtctgagaggaggagaaaatacacgctccaagtgtttcctcaggttggccacccttctgggcgattactgtggctccctgggcgaggggaccatctcccgcaatgtggctctggtatacgaa

SEQ ID NO: 277642 - DNA, 502 bp, Homo sapiens
gcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagactgtatcctagacccttggggctgggaaggggcggaggggcc

SEQ ID NO: 277643 - DNA, 1740 bp, Homo sapiens
gctggtaccggtctgggatgtagggatcaggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 277644 - DNA, 1433 bp, Homo sapiens
gcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggtgagacaatttcctgggttctagaactaccttggaacccaagccaagacctgtatgttcccaagactcactgcagagtgggggtggtggtagtggtgat

SEQ ID NO: 277645 - DNA, 2053 bp, Homo sapiens
agcggactgagtccttccacccgccagtccgcggggacagtggcggccgggatgtggccgagctcttctaccggaagctgacgggactgccaggagacgagtccccggttgtcatggtaaccagtggcgggaggcgggtgaggagcggggtcccgtcgggccgggtgggcgccagctccctcccaggactggttcattggtagattccacttggggggtgcattccgccaaataaagctaacgtgaggcccggcgcggtggctcacgcctgtaatcccagcactttgggagaccgaggcgggcggatcacctgaggtcaggagttcgaaatcagcctggccaacatggtgaaactccgcctctactaaaaatacaaaaaaaaaaaaaacttagctgggcgtggtggcgggcgcctgtaatcccatctactcgggaagctgaggcttgagaatcgcttgaatccaagaggcagaggttgcagtgagccgagatccggacaccgcactccagcctgggagacagagcgagactccctctcgggcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 277646 - DNA, 1966 bp, Homo sapiens
gcggccgcgcttggcgggctcagaggtcttgctcctggggaagctgagaatctccgcgcggtggactgtggccggccaaccgaaattggcgcgaaacgtcgccccccacgtgaccggcgccactgcgtgcgggccaatcggacaaggcggccttcttcacctcccgctagccgcaagccaatcaccgtgcgggcctagaatgagtgacggggaggcggtgcgggcgtcggaagggaatctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 277647 - DNA, 1481 bp, Homo sapiens
agcggactgagtccttccacccgccagtccgcggggacagtggcggccgggatgtggccgagctcttctaccggaagctgacgggactgccaggagacgagtccccggttgtcatggtaaccagtggcgggaggcgggtgaggagcggggtcccgtcgggccgggtgggcgccagctccctcccaggactggttcattggtagattccacttggggggtgcattccgccaaataaagctaacgtgaggcccggcgcggtggctcacgcctgtaatcccagcactttgggagaccgaggcgggcggatcacctgaggtcaggagttcgaaatcagcctggccaacatggtgaaactccgcctctactaaaaatacaaaaaaaaaaaaaacttagctgggcgtggtggcgggcgcctgtaatcccatctactcgggaagctgaggcttgagaatcgcttgaatccaagaggcagaggttgcagtgagccgagatccggacaccgcactccagcctgggagacagagcgagactccctctcgggcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatgggatccctgttgcacggtggatgtgccagggcagagatcaggtcaaagaggtttacttactaaggggtcttgaagatgcgcatatgagttagaggcacgacagttgagtggtgggagaagctcatgagctgccaaggttatggggcacgaaaaatcgggtgcacacagaaaagctggtcagttgaacaagcttctgtgaaattttgaaaacaataaaaaagtacacaataaaaaaacagtacaggaagagaaacacaaccacaagcggcgcaacctaacaacaggacagcgagaaacaaaatacacacaaagagaaccaaccacaaacaccagagcaaccaatccaggaaccagcaccccaggaaccaagaagaaaacccaaagagccagacaaaagcccaaggagaaaaaaaaagagggacaagaacacaagagcaaacaaacgcaacaagcaacaagagagaggaaagcccaccacga

SEQ ID NO: 277648 - DNA, 4564 bp, Homo sapiens
  misc_feature (4564)..(4564): n is a, c, g, or t
ctgattccataccagaggggctcaggatgctgttgctgggagctgttctactgctattagctctgcccgggcatgaccaggaaaccacgactcaagggcccggagtcctgcttcccctgcccaagggggcctgcacaggttggatggcgggcatcccagggcatccgggccataatggggccccaggccgtgatggcagagatggcacccctggtgagaagggtgagaaaggagatccaggtcttattggtcctaagggagacatcggtgaaaccggagtacccggggctgaaggtccccgaggctttccgggaatccaaggcaggaaaggagaacctggagaaggtgcctatgtataccgctcagcattcagtgtgggattggagacttacgttactatccccaacatgcccattcgctttaccaagatcttctacaatcagcaaaaccactatgatggctccactggtaaattccactgcaacattcctgggctgtactactttgcctaccacatcacagtctatatgaaggatgtgaaggtcagcctcttcaagaaggacaaggctatgctcttcacctatgatcagtaccaggaaaataatgtggaccaggcctccggctctgtgctcctgcatctggaggtgggcgaccaagtctggctccaggtgtatggggaaggagagcgtaatggactctatgctgataatgacaatgactccaccttcacaggctttcttctctaccatgacaccaactgatcaccactaactcagagcctcctccaggccaaacagccccaaagtcaattaaaggctttcagtacggttaggaagttgattattatttagttggaggcctttagatattattcattcatttactcattcatttattcattcattcatcaagtaactttaaaaaaatcatatgctatgttcccagtcctggggagcttcacaaacatgaccagataactgactagaaagaagtagttgacagtgctattttgtgcccactgtctctcctgatgctcatatcaatcctataaggcacagggaacaagcattctcctgtttttacagattgtatcctgaggctgagagagttaagtgaatgtctaaggtcacacagtattaagtgacagtgctagaaatcaaacccagagctgtggactttgttcactagactgtgcccttttatagaggtacatgttctctttggagtgttggtaggtgtctgtttcccacctcacctgagagccattgaatttgccttcctcatgaattaaaacctcccccaagcagagcttcctcagagaaagtggttctatgatgaagtcctgtcttggaaggactactactcaatggcccctgcactactctacttcctcttacctatgtcccttctcatgcctttccctccaacggggaaagccaactccatctctaagtgctgaactcatccctgttcctcaaggccacctggccaggagcttctctgatgtgatatccacttttttttttttttgagatggagtctcactctgtcacccaggctggagtacagtgacacgacctcggctcactgcagcctccttctcctgggtccaagcaattattgtgcctcagcctcccgagtagctgagacttcaggtgcattccaccacacatggctaatttttgtatttttagtagaaatggggtttcgtcatgttggccaggctggtctcgaactcctggcctaggtgatccacccgcctcgacctcccaaagtgctgggattacaggcatgagccaccatgcccagtcgatatctcactttttattttgccatggatgagagtcctgggtgtgaggaacacctcccaccaggctagaggcaactgcccaggaaggactgtgcttccgtcacctctaaatcccttgcagatccttgataaatgcctcatgaagaccaatctcttgaatcccatatctacccagaattaactccattccagtctctgcatgtaatcagttttatccacagaaacattttcattttaggaaatccctggtttaagtatcaatccttgttcagctggacaatatgaatcttttccactgaagttagggatgactgtgattttcagaacacgtccagaatttttcatcaagaaggtagcttgagcctgaaatgcaaaacccatggaggaattctgaagccattgtctccttgagtaccaacagggtcagggaagactgggcctcctgaatttattattgttctttaagaattacaggttgaggtagttgatggtggtaaacattctctcaggagacaataactccagtgatgtttttcaaagattttagcaaaaacagagtaaatagcattctctatcaatatataaatttaaaaaactatctttttgcttacagttttaaattctgaacaattctctcttatatgtgtattgctaatcattaaggtattattttttccacatataaagctttgtctttttgttgttgttgttgtttttaagatggagtttccctctgttgccaggctagagtgcagtggcatgatctcggcttactgcaacctttgcctcccaggtttaagcgattcttctgcctcagcctcccgagtagctgggaccacaggtgcctaccaccatgccaggctaatttttgtatttttagtaaagacagggtttcaccatattggccaggctggtctcgaactcctgaccttgtgatctgcccgcctccattgtgttgttatttgtgagaaagatagatatgaggtttagagagggatgaagaggtgagagtaagccttgtgttagtcagaactctgtgttgtgaatgtcattcacaacagaaaacccaaaatattatgcaaactactgtaagcaagaaaaataaaggaaaaatggaaacatttattcctttgcataatagaaattaccagagttgttctgtctttagataaggtttgaaccaaagctcaaaacaatcaagacccttttctgtatgtccttctgttctgccttccgcagtgtaggctttaccctcaggtgctacacagtatagttctagggtttccctcccgatatcaaaaagactgtggcctgcccagctctcgtatccccaagccacaccatctggctaaatggacatcatgttttctggtgatgcccaaagaggagagaggaagctctctttcccagatgccccagcaagtgtaaccttgcatctcattgctctggctgagttgtgtgcctgtttctgaccaatcactgagtcaggaggatgaaatattcatattgacttaattgcagcttaagttaggggtatgtagaggtattttccctaaagcaaaattgggacactgttatcagaaataggagagtggatgatagatgcaaaataatacctgtccacaacaaactcttaatgctgtgtttgagctttcatgagtttcccagagagacatagctggaaaattcctattgattttctctaaaatttcaacaagtagctaaagtctggctatgctcacagtctcacatctggtgggggtgggctccttacagaacacgctttcacagttaccctaaactctctggggcagggttattcctttgtggaaccagaggcacagagagagtcaactgaggccaaaagaggcctgagagaaactgaggtcaagatttcaggattaatggtcctgtgatgctttgaagtacaattgtggatttgtccaattctctttagttctgtcagcttttgcttcatatattttagcgctctattattagatatatacatgtttagtattatgtcttattggtgcatttactctcttatcattatgtaatgtccttctttatctgtgataattttctgtgttctgaagtctactttgtctaaaaataacatacgcactcaacttccttttctttcttccttcctttctttcttccttcctttctttctctctctctctttccttccttccttcctccttttctttctctctctctctctctctctttttttgacagactctcgttctgtggccctggctggagttcagtggtgtgatcttggctcactgctacctctaccatgagcaattctcctgcctcagcctcccaagtagctggaactacaggctcatgccactgcgcccagctaatttttgtatttttcgtagagacggggtttcaccacattcgtcaggttggtttcaaactcctgactttgtgatccacccgcctcggcctcccaaagtgctgggattacaggcatgagccatcacacctggtcaactttcttttgattagtgtttttgtggtatatctttttccatcatgttactttaaatatatctatattattgtatttaaaatgtgtttcttacagactgcatgtagttgggtataatttttatccagtctaaaaatatctgtcttttaattggtgtttagacaatttatatttaataaaatggtggaatttaaaactgcactgcccttaactcgagggggggcccggaacccaattcgccn

SEQ ID NO: 277649 - DNA, 4217 bp, Homo sapiens
ctgattccataccagaggggctcaggatgctgttgctgggagctgttctactgctattagctctgcccgggcatgaccaggaaaccacgactcaagggcccggagtcctgcttcccctgcccaagggggcctgcacaggttggatggcgggcatcccagggcatccgggccataatggggccccaggccgtgatggcagagatggcacccctggtgagaagggtgagaaaggagatccaggtcttattggtcctaagggagacatcggtgaaaccggagtacccggggctgaaggtccccgaggctttccgggaatccaaggcaggaaaggagaacctggagaaggtgcctatgtataccgctcagcattcagtgtgggattggagacttacgttactatccccaacatgcccattcgctttaccaagatcttctacaatcagcaaaaccactatgatggctccactggtaaattccactgcaacattcctgggctgtactactttgcctaccacatcacagtctatatgaaggatgtgaaggtcagcctcttcaagaaggacaaggctatgctcttcacctatgatcagtaccaggaaaataatgtggaccaggcctccggctctgtgctcctgcatctggaggtgggcgaccaagtctggctccaggtgtatggggaaggagagcgtaatggactctatgctgataatgacaatgactccaccttcacaggctttcttctctaccatgacaccaactgatcaccactaactcagagcctcctccaggccaaacagccccaaagtcaattaaaggctttcagtacggttaggaagttgattattatttagttggaggcctttagatattattcattcatttactcattcatttattcattcattcatcaagtaactttaaaaaaatcatatgctatgttcccagtcctggggagcttcacaaacatgaccagataactgactagaaagaagtagttgacagtgctattttgtgcccactgtctctcctgatgctcatatcaatcctataaggcacagggaacaagcattctcctgtttttacagattgtatcctgaggctgagagagttaagtgaatgtctaaggtcacacagtattaagtgacagtgctagaaatcaaacccagagctgtggactttgttcactagactgtgcccttttatagaggtacatgttctctttggagtgttggtaggtgtctgtttcccacctcacctgagagccattgaatttgccttcctcatgaattaaaacctcccccaagcagagcttcctcagagaaagtggttctatgatgaagtcctgtcttggaaggactactactcaatggcccctgcactactctacttcctcttacctatgtcccttctcatgcctttccctccaacggggaaagccaactccatctctaagtgctgaactcatccctgttcctcaaggccacctggccaggagcttctctgatgtgatatccacttttttttttttttgagatggagtctcactctgtcacccaggctggagtacagtgacacgacctcggctcactgcagcctccttctcctgggtccaagcaattattgtgcctcagcctcccgagtagctgagacttcaggtgcattccaccacacatggctaatttttgtatttttagtagaaatggggtttcgtcatgttggccaggctggtctcgaactcctggcctaggtgatccacccgcctcgacctcccaaagtgctgggattacaggcatgagccaccatgcccagtcgatatctcactttttattttgccatggatgagagtcctgggtgtgaggaacacctcccaccaggctagaggcaactgcccaggaaggactgtgcttccgtcacctctaaatcccttgcagatccttgataaatgcctcatgaagaccaatctcttgaatcccatatctacccagaattaactccattccagtctctgcatgtaatcagttttatccacagaaacattttcattttaggaaatccctggtttaagtatcaatccttgttcagctggacaatatgaatcttttccactgaagttagggatgactgtgattttcagaacacgtccagaatttttcatcaagaaggtagcttgagcctgaaatgcaaaacccatggaggaattctgaagccattgtctccttgagtaccaacagggtcagggaagactgggcctcctgaatttattattgttctttaagaattacaggttgaggtagttgatggtggtaaacattctctcaggagacaataactccagtgatgtttttcaaagattttagcaaaaacagagtaaatagcattctctatcaatatataaatttaaaaaactatctttttgcttacagttttaaattctgaacaattctctcttatatgtgtattgctaatcattaaggtattattttttccacatataaagctttgtctttttgttgttgttgttgtttttaagatggagtttccctctgttgccaggctagagtgcagtggcatgatctcggcttactgcaacctttgcctcccaggtttaagcgattcttctgcctcagcctcccgagtagctgggaccacaggtgcctaccaccatgccaggctaatttttgtatttttagtaaagacagggtttcaccatattggccaggctggtctcgaactcctgaccttgtgatctgcccgcctccattgtgttgttatttgtgagaaagatagatatgaggtttagagagggatgaagaggtgagagtaagccttgtgttagtcagaactctgtgttgtgaatgtcattcacaacagaaaacccaaaatattatgcaaactactgtaagcaagaaaaataaaggaaaaatggaaacatttattcctttgcataatagaaattaccagagttgttctgtctttagataaggtttgaaccaaagctcaaaacaatcaagacccttttctgtatgtccttctgttctgccttccgcagtgtaggctttaccctcaggtgctacacagtatagttctagggtttccctcccgatatcaaaaagactgtggcctgcccagctctcgtatccccaagccacaccatctggctaaatggacatcatgttttctggtgatgcccaaagaggagagaggaagctctctttcccagatgccccagcaagtgtaaccttgcatctcattgctctggctgagttgtgtgcctgtttctgaccaatcactgagtcaggaggatgaaatattcatattgacttaattgcagcttaagttaggggtatgtagaggtattttccctaaagcaaaattgggacactgttatcagaaataggagagtggatgatagatgcaaaataatacctgtccacaacaaactcttaatgctgtgtttgagctttcatgagtttcccagagagacatagctggaaaattcctattgattttctctaaaatttcaacaagtagctaaagtctggctatgctcacagtctcacatctggtgggggtgggctccttacagaacacgctttcacagttaccctaaactctctggggcagggttattcctttgtggaaccagaggcacagagagagtcaactgaggccaaaagaggcctgagagaaactgaggtcaagatttcaggattaatggtcctgtgatgctttgaagtacaattgtggatttgtccaattctctttagttctgtcagcttttgcttcatatattttagcgctctattattagatatatacatgtttagtattatgtcttattggtgcatttactctcttatcattatgtaatgtccttctttatctgtgataattttctgtgttctgaagtctactttgtctaaaaataacatacgcactcaacttccttttctttcttccttcctttctttcttccttcctttctttctctctctctctttccttccttccttcctccttttctttctctctctctctctctctctttttttgacagactctcgttctgtggccctggctggagttcagtggtgtgatcttggctcactgctacctctaccatgagcaattctctggaacctgggaggcggaggttgccgtgagacaagatagtgccattgtactccagcctgggcaacagagtgagactccatctc

SEQ ID NO: 277650 - DNA, 680 bp, Homo sapiens
ggtgatgttctgtgccctttgagtttaccttacttttgcagattacagagtaagccgccagcagaagcaataaagacattactgggcctttgcactgcaacatcatgcctctgaagaaaaaaaaagtgcaaacattacaatagattcagctcctttagttctcacttctgtctccacgtcaagataaaatactgacattgaaatagaatggatgacatgcttgaaatgagtcatgtgcctgaaaagtcattaacaaacaacagttccagagaaaagccaggaaaaactccccatggatttagagacagagctctcaccttcaacaggttactttttccttgtctcaggcttccttggaaaacaacctataactaactttctgggagtaaagcttcaggtggaagaacaattggatcaaacttggaaaacatgcccccagtttgtctactccattgaactttgcatgcttggagcccctggcctcagcacactcaatcgcacaagccagcctgcagcacctgtacagcaccatgggagtcccctgcagagctgcaactttgagagtgggtatagtgacgtaactcaggttcttcaagggatgaacactccaactttgaaaccactagcctgtaggtgtggacgaaaaggcagctgcatgttataaaacaatattactcata

SEQ ID NO: 277651 - DNA, 456 bp, Homo sapiens
ctcctttaaggatctttccaaaggtcttcaattttgatataagcaacaaagaataagagggctattagatcagaaatattccatgaagaagggagcaaagattcatgtcactgacaactggagaagaaacagagaaagggtactcatgatgtgtgacaaatggcatgcctcctgcaagagttatgagttatgtgcctaaacaggaaggatcatctcattgcagaattagggcatcatccagtgggaagggagtttcaaggtcatttagtccagcctccgagtgatacagaaattctctttgcagcatccctatcacgtggccatcaaacttctactagtgtattcatccacacctggtctgtctaaaaccttgagaacagccccttgtatagttcaatagccccagctgaaggaaaagtttttgttattttcagtaaacatattctgttgtgtaac

SEQ ID NO: 277652 - DNA, 1753 bp, Homo sapiens
ggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccagga

SEQ ID NO: 277653 - DNA, 1662 bp, Homo sapiens
ggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatg

SEQ ID NO: 277654 - DNA, 1305 bp, Homo sapiens
tggtcctttgaaaattcagtagtggattgtacattttcccacatccctatcttcataaccactattttaattgacttttatattccagtaggggtgttacagtttacctaattattcctgttaggcaacgtctgatattttttttgccagttttttgtaagtcatgttgtgaaaataacatctgtatctcttcagtttttccagtaatttccttgatgagttctcactgtaatcaggtcaaagatcaggaacatttcagtaatttataaatactgctaaattgttttctacgagggtaatatcaatttgtatatttgagtaccatgcctgtttatactgtaattgaccatatttctaatgactattttcttccatgtgttcagctttttactttttctgaactattatctatgccaagtgttatccagtagaatttcctgcagtcataaaaatactgtataatcttcactgtctagtatcatagttaggagccacatgtggctggtgcaccgttgaaatgtggccagtgtgactgaggaatggaatttttaatttgaaaccaagtagctgcatatggctagtgctaccgtattttattttgtgggagtattctgctgcttttcactcttctatttgaagttgctcactcacatgccatttgcccatccctggtgagattgaatttttaccgaaacttggccctctagactgtttagggacagcagacacatgttgcctgtatgtgaaatgtaaaatgtaaaatgtaaaatgttttgtctacaagcaatcgtagtgcactgtggaaactcactgcttccctgttaggtaatgcaagtctaaagactactccagtttatcctctctgcctccttatcttctcaatgattgtttcatttctaaatgcccattccttttcagtcgtaccatatgtcctcatctccctttagttttctttttgctattaatagttttagcttttcagtctaatgtctgatgctgatgtcctctatttagcagggatggtgagagaaggtcagctaaatggctcatctgcagcacacagtgaaataagaggtatactgtttcctattctactatttatcactctgtagcagaaagtctttctaggtccttggttaagaatatagagaatgttactttggacctcacattgccaaattttaaaaaacactgtagagaatgattttcctctcctacccattaaggattctatcttttcctatcaagtctattacaatctagtgcagtgatcagttaattttttgaaaaaagttggcggccggg

SEQ ID NO: 277655 - DNA, 1921 bp, Homo sapiens
ggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccaggaccctggctctacttttagagtcattgtaagaaactctaacttgcatcaaggtactaataagcttaattttaataacccaaagtttaaaggttccgatctttctccttggggtggagtgatctcattctcaggacaaccgtttacttacctgattcctcggagcattat

SEQ ID NO: 277656 - DNA, 1700 bp, Homo sapiens
ggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccagga

SEQ ID NO: 277657 - DNA, 1745 bp, Homo sapiens
ggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtgctcagccctgccaagctggttgggctatatgtgtgttgtgcaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccagga

SEQ ID NO: 277658 - DNA, 1187 bp, Homo sapiens
ccacacacaacacaccacacaaaaaacagcaccgcacaactaacggctacggacgaggccgggtgttaatcggccgaccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccagga

SEQ ID NO: 277659 - DNA, 1611 bp, Homo sapiens
tggtcctttgaaaattcagtagtggattgtacattttcccacatccctatcttcataaccactattttaattgacttttatattccagtaggggtgttacagtttacctaattattcctgttaggcaacgtctgatattttttttgccagttttttgtaagtcatgttgtgaaaataacatctgtatctcttcagtttttccagtaatttccttgatgagttctcactgtaatcaggtcaaagatcaggaacatttcagtaatttataaatactgctaaattgttttctacgagggtaatatcaatttgtatatttgagtaccatgcctgtttatactgtaattgaccatatttctaatgactattttcttccatgtgttcagctttttactttttctgaactattatctatgccaagtgttatccagtagaatttcctgcagtcataaaaatactgtataatcttcactgtctagtatcatagttaggagccacatgtggctggtgcaccgttgaaatgtggccagtgtgactgaggaatggaatttttaatttgaaaccaagtagctgcatatggctagtgctaccgtattttattttgtgggagtattctgctgcttttcactcttctatttgaagttgctcactcacatgccatttgcccatccctggtgagattgaatttttaccgaaacttggccctctagactgtttagggacagcagacacatgttgcctgtatgtgaaatgtaaaatgtaaaatgtaaaatgttttgtctacaagcaatcgtagtgcactgtggaaactcactgcttccctgttaggtaatgcaagtctaaagactactccagtttatcctctctgcctccttatcttctcaatgattgtttcatttctaaatgcccattccttttcagtcgtaccatatgtcctcatctccctttagttttctttttgctattaatagttttagcttttcagtctaatgtctgatgctgatgtcctctatttagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccagga

SEQ ID NO: 277660 - DNA, 914 bp, Homo sapiens
ctttgggaggctgaggcaggaggattgcttgagcccaggagtttgagaccagcctgagcaacatagcaagatgctgtttctacaaaaaaaatttttttaaattgctaggtctggtgctgtgtgcctatagtcccggctactggctgaggtaggaggattgcttgagcccagtgagctgattgtgccactgcatttgagcctgggtgacaaagaccttgtctctaaaaagtaaataaaattttaaataaattacaagattcctagaatctcctgtcttgccttctgaagggttaggattgacttaagtatctgcagcttccaatgtataaacctgttttgtgaaacttcattttgttctcttttctttctccctacaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccagga

SEQ ID NO: 277661 - DNA, 525 bp, Homo sapiens
gtcacaccactacactctagcccaggtgaaagagtgagactccgtctcaaaaaatatataaagcataaaaaataaagaagtaaactactgcaccagtacactgacaccagctctatgaaacgctgattagagagcctacagaagaatggcaggtaaagataaaattttagaccaatcatcaagttacagcaataagcaagagatcacactccttgatgggacataccaacccacttaagtcttgcttaattggtcatcacagtctgctcaacgtagcatgaccttcttgtttcagacttgccttgagtgtgtcttcacaatgtcaatatgttgtatcttttccttccagagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgaga

SEQ ID NO: 277662 - DNA, 2139 bp, Homo sapiens
ggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccaggaaaaaaaaaaaaaaaaaaaaaaaaaaaaaaaaaaaacaaaaaaaaaagaaaacaaaaaaaaaaaagaagggggggcgcccaaaaaaatacccccgagggggccccaaattaaccgccccccctattgtggaaaaaagggcgccccacattaggggtacctattataaaacacgcagacagtggcccgcgattttcaaacaaacgagaatggagacaaaatggcacacacgggaactattgtggggagagcgcaacccacccatacctgacgggggggaacaacacaaataggggcacaaccctcccacaacgaagatataaaagccttttgagggccaattttaacacctcaagaggtctaacagggtgaaaccacaagcgcgtagt

SEQ ID NO: 277663 - DNA, 1799 bp, Homo sapiens
ggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtgctcagccctgccaagctggttgggctatatgtgtgttgtgcaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccagga

SEQ ID NO: 277664 - DNA, 1525 bp, Homo sapiens
ggtggggcctgggcgagtcacgtggggacggtgcgcgctcagtgcggctgcgccggccggtagctgcagctggagcagtggcgtttggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctgtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccagga

SEQ ID NO: 277665 - DNA, 3109 bp, Homo sapiens
tcagaaccacatagggaatctgcatgccctgatctcaggcaaatgtatgcaaatacatatttcgggagatcaccctgaaattctgcactgaactccattttaatgtcctccttgtcatgtggtgttgagatgactagtaggtacataaggtttcatgccctctgtcagtctgttagagacaacagaggtgatggtgatcactaatgttgcctgcatcttatatgcagctcattgcatagtgaaagagcctctattaggccaggcgtggtggctcacacctataatcccagcactttgggaggccaaagcaggcagatcgcttgaggccaggagtttgagaccagctatggccaacatggcaaaaccccatctcttctaaaaatacaaaaattagccaggcagggtgatgcatgcctgtaatcccagctactccaaaggctgagacatgagaatcacttgaccctgggaggcagaggttgcagtgagccaagattgtgccactacactgctgcctgggcaacacagacactgtccaaaaaaaattgacctaaaacatgacaaagacagcatggaaaaaaaaaaaaatttttaataacaaagaacttctattaaaaatggtttctgggataagatgggtgtttcaaggagattgcacattaagatatggtatgagtgtgatctgaagttttaaaataagctgcatacatccacttattcagaatgatagctttttatttcaggtcaagagggacagcccagagtctaagaggatcatattcagctcacagctgcagttctcaaattacactgatcaggcagattctgacaaatccaacactcttggtgcctgcctgcccctacacctttaaaacccttaaagcagtaactttggagttgtcaagatttgttaatttttgaatttctccctctcaattcccttccccagtctgctccttaataaacaaccaggaagcagaaccaagcttcattcaacattgggttaggctgccataaccaaatatcacaggctaggcagcttacacaacagatgtttatttctcgcagttctgaaggctgtaaattccaagatcaaggtgctagcagcttcactgtctggtgagggctctcttcttggtttgtagatggctgccttcttcttgtgccctcgcatagtggagagagagtgtgtacacaagctctcccgtcttttcttataagggcactaatccattcctgaggacttcctcaacctcgttacctcatctaaacctaattacctcccaagggcttcatctctgaataccatcatattgtgggttagggctttaataggaaactttgggaagacaccattcagtccatagcaaacatgatgttccaggacatagatctgttccaaaacaagctagaatgttgacctgtgtgttgttgcaaggtcggaacgtccaggctttggagaaaagctggttgcatgttcagatgcataagttttctcacatagggtcctaatatagtgttgtgcttattcctgatgacagaataatcaggtagatatttagtaaagaagtttccagaaaatagaaagtgatcaggaaagtgttgactgcttttgtagaactcagttgttgttgttgttttcctactactattagttttctatcgtcagtgaaaatttggtctggattgagaaagagagatctagtcttgtgatctaggcaaaggaaaatgtatgctgtcttgtgagtctagcttaaatagcattgctagcaaggatgtctggagcaatctactttatattgctaattatgatgctttctcatgatataggtgaccatttggcaacacgtttattttcttttgcagcctgtttgcaaggtttcaccagagacaacacttccagcagcttctccgaggatgcaggaatatctctgagcacctctgtgaagttaccccttgcctcttcatctaagcctaatgaaaattgaagctttgcccaaccagccaccttctcagcagatgaggcacaactaccgcttattagccagtactgtgtctgcagaaatggccaggaacaggcagctaatttgggaactggccagacaatcagaagcacacctggacaggccagttgtccttggggaacaggccagtgcccagcgtgaggttgccagtattctttgtagaaaatcagtgcttgcaataaaccaactggctgcaactgtagaagggacaattagtgtcctacagcaatttaatgaactattagaccatcctctggatcccgggaggtcttgatcacagctggtagaggtggccactcactgttctatgtcttttaggttaacagttctttacataacagtgaagagtcctggtgcctcaggaaaagcaagatcaacctaccaaggaagagttgatggagtcataattttcctacttaacacccactgcaaatttaaatatgtgttctagggctgtttgttaattctattatggtctttactaattgtgattcccagttctgggtgaataaaaagtttttgttttaatgtaattgtgatcaacactatgcttgaagacatagacaaagctatttctaccaccatgatgtttacaaaatatctggtattttcgcctatatggccattaaaaaaactagatttgtggataacaaaccaccaagttttaattgtttttatttaataagggagaaataagatagaaaaagagaattaatactctttttcccagactgagaggcgggcttctaagtaaaggtatgtgaaaaactgagtagaggcttgtagtactaaaatgaacctccaaaatttattcttttctctgaggatttatctcagcttctctgtgtaattggatattaacacatcttaaattttttaaagagatggggtctcactgtgttgctcaggctggagtgcagtggttactcacaggtgcagtcatggcacactgtaacctcaaactactaggctcaagcaatcctcttgcctcagccccactgagtagctggggctatatgcatgtaccacccactggcatgtcttaaatacttctaagggagcaaaacacatgctctctcacctcattt

SEQ ID NO: 277666 - DNA, 2763 bp, Homo sapiens
agacgttagtgaagtgaatactcaccgacggtatcggaatgtgccatttggaccggtcggcagcagctacggttgccggtcccgcactgaaaaacgacagtggtgacgggtgagctcccagaagcagaagaatgacaggcaacacctgaagccacgcagccgccgccatcttcacagccgtggagtgcctaccgaaagcatttcaccctcttccggttcgtcccgccttcttccggctctgctctaagggcgggattatccgggtcctggaaacgtcgcggagcttgtttgctgtgcggcgtagcggcccctctctcagacagtcgtctgtgcgccgtgagactttggacctactgcgcaggcgtcatcctgttggaacctggtcagctgggttagagagatcgctacatgccagcctggcctgagtcttttctgtctcccagccgttaaaggttttaggaccaggcaggcaccccgtgcaggatttggctctctacttccgctcgccccagcccttcatcccttctaagtcaatgtcagactttggggccagaaagtctggaaaagccctaagcctggctgcccaagtggcgtctagtagtgagttctccggtttgggtggtatttaagcaaaggctggaattcggcggtggtggagtacacgcgattcctagactgggtagtgtaacaaccttcaaaggccccttctagccctgaagagtacgatgctgcagtacaatctggctggagacctagcctccagcaaagacccggccggcacttcccacccttaaccgaaaacggagacagagagggtcagttttcaaaatctgtggcgtgaccccgccactgagatagatctgcagatgcttcgtcccagtcagggaggccgtctcggcatttccaggttcttaacgctcttgatttttaccctctaggactcattgcgtacacgccctcaccgccgcccagtttcggttcctaacaaaagcacgttcctcatcagccacccataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtgttgaagatgaagctgtagataaaaacattttcagagactgtaacaagatcgcattttacaggaagaaaagcgtattatgttaattctgaacaggtatctagagggaagtctacagtgaatgcctggcgtcagaaacagtggctttccaagaagtccacctatcgggcattattggattcagtcacaacagatgaagacagcaccaggttccaaatcatcaatgaagcaagtaagcctgtttgcaaggtttcaccagagacaacacttccagcagcttctccgaggatgcaggaatatctctgagcacctctgtgaagttaccccttgcctcttcatctaagcctaatgaaaattgaagctttgcccaaccagccaccttctcagcagatgaggcacaactaccgcttattagccagtactgtgtctgcagaaatggccaggaacaggcagctaatttgggaactggccagacaatcagaagcacacctggacaggccagttgtccttggggaacaggccagtgcccagcgtgaggttgccagtattctttgtagaaaatcagtgcttgcaataaaccaactggctgcaactgtagaagggacaattagtgtcctacagcaatttaatgaactattagaccatcctctggatcccgggaggtcttgatcacagctggtagaggtggccactcactgttctatgtcttttaggttaacagttctttacataacagtgaagagtcctggtgcctcaggaaaagcaagatcaacctaccaaggaagagttgatggagtcataattttcctacttaacacccactgcaaatttaaatatgtgttctagggctgtttgttaattctattatggtctttactaattgtgattcccagttctgggtgaataaaaagtttttgttttaatgtaattgtgatcaacactatgcttgaagacatagacaaagctatttctaccaccatgatgtttacaaaatatctggtattttcgcctatatggccattaaaaaaactagatttgtggataacaaaccaccaagttttaattgtttttatttaataagggagaaataagatagaaaaagagaattaatactctttttcccagactgagaggcgggcttctaagtaaaggtatgtgaaaaactgagtagaggcttgtagtactaaaatgaacctccaaaatttattcttttctctgaggatttatctcagcttctctgtgtaattggatattaacacatcttaaattttttaaagagatggggtctcactgtgttgctcaggctggagtgcagtggttactcacaggtgcagtcatggcacactgtaacctcaaactactaggctcaagcaatcctcttgcctcagccccactgagtagctggggctatatgcatgtaccacccactggcatgtcttaaatacttctaagggagcaaaacacatgctctctcacctcattt

SEQ ID NO: 277667 - DNA, 2193 bp, Homo sapiens
agacgttagtgaagtgaatactcaccgacggtatcggaatgtgccatttggaccggtcggcagcagctacggttgccggtcccgcactgaaaaacgacagtggtgacgggtgagctcccagaagcagaagaatgacaggcaacacctgaagccacgcagccgccgccatcttcacagccgtggagtgcctaccgaaagcatttcaccctcttccggactcattgcgtacacgccctcaccgccgcccagtttcggttcctaacaaaagcacgttcctcatcagccacccataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtgttgaagatgaagctgtagataaaaacattttcagagactgtaacaagatcgcattttacaggcgtcagaaacagtggctttccaagaagtccacctatcgggcattattggattcagtcacaacagatgaagacagcaccaggttccaaatcatcaatgaagcaagtaaggtcaggtgccaggaccagagcccaacaactctggatgccttcaaaggcaaagaaaccacagtccaggaggagacacaggatctcagcacaagacagcacctggctcaaaaggaagctgaggagcctgataaacaaggacaaattacctgggacatcagcaacgtagctcccaagactgagaactttgaggacctcttggaacaaactccatgctcagcctgtttgcaaggtttcaccagagacaacacttccagcagcttctccgaggatgcaggaatatctctgagcacctctgtgaagttaccccttgcctcttcatctaagcctaatgaaaattgaagctttgcccaaccagccaccttctcagcagatgaggcacaactaccgcttattagccagtactgtgtctgcagaaatggccaggaacaggcagctaatttgggaactggccagacaatcagaagcacacctggacaggccagttgtccttggggaacaggccagtgcccagcgtgaggttgccagtattctttgtagaaaatcagtgcttgcaataaaccaactggctgcaactgtagaagggacaattagtgtcctacagcaatttaatgaactattagaccatcctctggatcccgggaggtcttgatcacagctggtagaggtggccactcactgttctatgtcttttaggttaacagttctttacataacagtgaagagtcctggtgcctcaggaaaagcaagatcaacctaccaaggaagagttgatggagtcataattttcctacttaacacccactgcaaatttaaatatgtgttctagggctgtttgttaattctattatggtctttactaattgtgattcccagttctgggtgaataaaaagtttttgttttaatgtaattgtgatcaacactatgcttgaagacatagacaaagctatttctaccaccatgatgtttacaaaatatctggtattttcgcctatatggccattaaaaaaactagatttgtggataacaaaccaccaagttttaattgtttttatttaataagggagaaataagatagaaaaagagaattaatactctttttcccagactgagaggcgggcttctaagtaaaggtatgtgaaaaactgagtagaggcttgtagtactaaaatgaacctccaaaatttattcttttctctgaggatttatctcagcttctctgtgtaattggatattaacacatcttaaattttttaaagagatggggtctcactgtgttgctcaggctggagtgcagtggttactcacaggtgcagtcatggcacactgtaacctcaaactactaggctcaagcaatcctcttgcctcagccccactgagtagctggggctatatgcatgtaccacccactggcatgtcttaaatacttctaagggagcaaaacacatgctctctcacctcattt

SEQ ID NO: 277668 - DNA, 200 bp, Homo sapiens
agctgctaaagaaaatgaggaggagacatcagtggacacctctcaggtaatctagattgatccatttattgttatctttttcaccatcatcatcatgatagggcatataaggaattctctttcttccttctacagaagggtgcttgttaaatgatcgactgcatataaataggaccacttgtttcttcggctcaccttgt

SEQ ID NO: 277669 - DNA, 233 bp, Homo sapiens
tgtttgtgccctgaaattcactgaatatcatagtgaattttaatgacttccacatgataatatagtcttttggatactgacaatcacaaataattatcaagcatctgcatactccgtatctataggcgtcagaaacagtggctttccaagaagtccacctatcgggcattattggattcagtcacaacagatgaagacagcaccaggttccaaatcatcaatgaagcaagtaa

SEQ ID NO: 277670 - DNA, 317 bp, Homo sapiens
agtgtcctacagcaatttaatgaactattagaccatcctctggatcccgggaggtcttgatcacagctggtagaggtggccactcactgttctatgtcttttaggttaacagttctttacataacagtgaagagtcctggtgcctcaggaaaagcaagatcaacctaccaaggaagagttgatggagtcataattttcctacttaacacccactgcaaatttaaatatgtgttctagggctgtttgttaattctattatggtctttactaattgtgattcccagttctgggtgaataaaaagtttttgttttaatgt

SEQ ID NO: 277671 - DNA, 2360 bp, Homo sapiens
agacgttagtgaagtgaatactcaccgacggtatcggaatgtgccatttggaccggtcggcagcagctacggttgccggtcccgcactgaaaaacgacagtggtgacgggtgagctcccagaagcagaagaatgacaggcaacacctgaagccacgcagccgccgccatcttcacagccgtggagtgcctaccgaaagcatttcaccctcttccggttcgtcccgccttcttccggctctgctctaagggcgggattatccgggtcctggaaacgtcgcggagcttgtttgctgtgcggcgtagcggcccctctctcagacagtcgtctgtgcgccgtgagactttggacctactgcgcaggcgtcatcctgttggaacctggactcattgcgtacacgccctcaccgccgcccagtttcggttcctaacaaaagcacgttcctcatcagccacccataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtgttgaagatgaagctgtagataaaaacattttcagagactgtaacaagatcgcattttacaggcgtcagaaacagtggctttccaagaagtccacctatcgggcattattggattcagtcacaacagatgaagacagcaccaggttccaaatcatcaatgaagcaagtaaggtcaggtgccaggaccagagcccaacaactctggatgccttcaaaggcaaagaaaccacagtccaggaggagacacaggatctcagcacaagacagcacctggctcaaaaggaagctgaggagcctgataaacaaggacaaattacctgggacatcagcaacgtagctcccaagactgagaactttgaggacctcttggaacaaactccatgctcagcctgtttgcaaggtttcaccagagacaacacttccagcagcttctccgaggatgcaggaatatctctgagcacctctgtgaagttaccccttgcctcttcatctaagcctaatgaaaattgaagctttgcccaaccagccaccttctcagcagatgaggcacaactaccgcttattagccagtactgtgtctgcagaaatggccaggaacaggcagctaatttgggaactggccagacaatcagaagcacacctggacaggccagttgtccttggggaacaggccagtgcccagcgtgaggttgccagtattctttgtagaaaatcagtgcttgcaataaaccaactggctgcaactgtagaagggacaattagtgtcctacagcaatttaatgaactattagaccatcctctggatcccgggaggtcttgatcacagctggtagaggtggccactcactgttctatgtcttttaggttaacagttctttacataacagtgaagagtcctggtgcctcaggaaaagcaagatcaacctaccaaggaagagttgatggagtcataattttcctacttaacacccactgcaaatttaaatatgtgttctagggctgtttgttaattctattatggtctttactaattgtgattcccagttctgggtgaataaaaagtttttgttttaatgtaattgtgatcaacactatgcttgaagacatagacaaagctatttctaccaccatgatgtttacaaaatatctggtattttcgcctatatggccattaaaaaaactagatttgtggataacaaaccaccaagttttaattgtttttatttaataagggagaaataagatagaaaaagagaattaatactctttttcccagactgagaggcgggcttctaagtaaaggtatgtgaaaaactgagtagaggcttgtagtactaaaatgaacctccaaaatttattcttttctctgaggatttatctcagcttctctgtgtaattggatattaacacatcttaaattttttaaagagatggggtctcactgtgttgctcaggctggagtgcagtggttactcacaggtgcagtcatggcacactgtaacctcaaactactaggctcaagcaatcctcttgcctcagccccactgagtagctggggctatatgcatgtaccacccactggcatgtcttaaatacttctaagggagcaaaacacatgctctctcacctcattt

SEQ ID NO: 277672 - DNA, 2916 bp, Homo sapiens
agacgttagtgaagtgaatactcaccgacggtatcggaatgtgccatttggaccggtcggcagcagctacggttgccggtcccgcactgaaaaacgacagtggtgacgggtgagctcccagaagcagaagaatgacaggcaacacctgaagccacgcagccgccgccatcttcacagccgtggagtgcctaccgaaagcatttcaccctcttccggttcgtcccgccttcttccggctctgctctaagggcgggattatccgggtcctggaaacgtcgcggagcttgtttgctgtgcggcgtagcggcccctctctcagacagtcgtctgtgcgccgtgagactttggacctactgcgcaggcgtcatcctgttggaacctggtcagctgggttagagagatcgctacatgccagcctggcctgagtcttttctgtctcccagccgttaaaggttttaggaccaggcaggcaccccgtgcaggatttggctctctacttccgctcgccccagcccttcatcccttctaagtcaatgtcagactttggggccagaaagtctggaaaagccctaagcctggctgcccaagtggcgtctagtagtgagttctccggtttgggtggtatttaagcaaaggctggaattcggcggtggtggagtacacgcgattcctagactgggtagtgtaacaaccttcaaaggccccttctagccctgaagagtacgatgctgcagtacaatctggctggagacctagcctccagcaaagacccggccggcacttcccacccttaaccgaaaacggagacagagagggtcagttttcaaaatctgtggcgtgaccccgccactgagatagatctgcagatgcttcgtcccagtcagggaggccgtctcggcatttccaggttcttaacgctcttgatttttaccctctaggactcattgcgtacacgccctcaccgccgcccagtttcggttcctaacaaaagcacgttcctcatcagccacccataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtgttgaagatgaagctgtagataaaaacattttcagagactgtaacaagatcgcattttacaggcgtcagaaacagtggctttccaagaagtccacctatcgggcattattggattcagtcacaacagatgaagacagcaccaggttccaaatcatcaatgaagcaagtaaggtcaggtgccaggaccagagcccaacaactctggatgccttcaaaggcaaagaaaccacagtccaggaggagacacaggatctcagcacaagacagcacctggctcaaaaggaagctgaggagcctgataaacaaggacaaattacctgggacatcagcaacgtagctcccaagactgagaactttgaggacctcttggaacaaactccatgctcagcctgtttgcaaggtttcaccagagacaacacttccagcagcttctccgaggatgcaggaatatctctgagcacctctgtgaagttaccccttgcctcttcatctaagcctaatgaaaattgaagctttgcccaaccagccaccttctcagcagatgaggcacaactaccgcttattagccagtactgtgtctgcagaaatggccaggaacaggcagctaatttgggaactggccagacaatcagaagcacacctggacaggccagttgtccttggggaacaggccagtgcccagcgtgaggttgccagtattctttgtagaaaatcagtgcttgcaataaaccaactggctgcaactgtagaagggacaattagtgtcctacagcaatttaatgaactattagaccatcctctggatcccgggaggtcttgatcacagctggtagaggtggccactcactgttctatgtcttttaggttaacagttctttacataacagtgaagagtcctggtgcctcaggaaaagcaagatcaacctaccaaggaagagttgatggagtcataattttcctacttaacacccactgcaaatttaaatatgtgttctagggctgtttgttaattctattatggtctttactaattgtgattcccagttctgggtgaataaaaagtttttgttttaatgtaattgtgatcaacactatgcttgaagacatagacaaagctatttctaccaccatgatgtttacaaaatatctggtattttcgcctatatggccattaaaaaaactagatttgtggataacaaaccaccaagttttaattgtttttatttaataagggagaaataagatagaaaaagagaattaatactctttttcccagactgagaggcgggcttctaagtaaaggtatgtgaaaaactgagtagaggcttgtagtactaaaatgaacctccaaaatttattcttttctctgaggatttatctcagcttctctgtgtaattggatattaacacatcttaaattttttaaagagatggggtctcactgtgttgctcaggctggagtgcagtggttactcacaggtgcagtcatggcacactgtaacctcaaactactaggctcaagcaatcctcttgcctcagccccactgagtagctggggctatatgcatgtaccacccactggcatgtcttaaatacttctaagggagcaaaacacatgctctctcacctcattt

SEQ ID NO: 277673 - DNA, 1216 bp, Homo sapiens
agacgttagtgaagtgaatactcaccgacggtatcggaatgtgccatttggaccggtcggcagcagctacggttgccggtcccgcactgaaaaacgacagtggtgacgggtgagctcccagaagcagaagaatgacaggcaacacctgaagccacgcagccgccgccatcttcacagccgtggagtgcctaccgaaagcatttcaccctcttccggactcattgcgtacacgccctcaccgccgcccagtttcggttcctaacaaaagcacgttcctcatcagccacccataatcaagacaaatttgccaaataaatcattgtagaaacgctagtttgggcctgaaaaattccaggagcaagagtcaagatttgtcactccatgagaatctggaggggactcccttcccagaaacttgacgatgaagtactggttgtaattttagaaagacacccaatcggcttttttaaaagatcgcccagggcccttgtcctgagagctgggagctggtcggagtgacagagaagccatggaagcagcagtgaaagaggaaataagtgttgaagatgaagctgtagataaaaacattttcagagactgtaacaagatcgcattttacaggcgtcagaaacagtggctttccaagaagtccacctatcgggcattattggattcagtcacaacagatgaagacagcaccaggttccaaatcatcaatgaagcaagtaaggttcctctcctggctgaaatttatggtatagaaggaaacattttcaggcttaaaattaatgaagagactcctctaaaacccagatttgaagttccggatgtcctcacaagcaagccaagcactgtaaggctgatttcatgctctggggacacaggcagtctgatattggcagatggaaaaggagacctgaagtgccatatcacagcaaacccattcaaggtagacttggtgtctgaagaagaggttgtgattagcataaattccctgggccaattatactttgagcatctacagattcttcacaaacaaagagctgctaaagaaaatgaggaggagacatcagtggacacctctcaggaaaatcaagaagatctgggcctgtgggaagagaaatttggaaaatttgtggatatcaaagctaatggcccttcttctattggtttggatttctccttgcatggatttgagcatctttatgggatccca

SEQ ID NO: 277674 - DNA, 404 bp, Homo sapiens
aagctacactcatgttcattcattcaacaaatatgtattgagtacttccatgtgccagacactgttccagatggtgaggaaacatcaatgggcaaaagtgcgtgccttcgtggagattacactctagtgaggggagacagaccataaacatgacacgatcttcggaagaacggatgatcctggaagtaatccgggcacacttacatttgttgtcaacaagaacaatcctttcatcttcttgggcttgaaagagatggagtttcaccatgttgcccaggctggtcttaaactcctgacctcaagtgatccacctgcctcgagcctcccaaagtgctgggattacagagccaccgcacctgaccttgataagtattgcaaggaataaacaaaggaaattttgtatc

SEQ ID NO: 277675 - DNA, 2321 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaaccttt

SEQ ID NO: 277676 - DNA, 1864 bp, Homo sapiens
atactaaaattggaacgatacagagaagattagcatggcccctgcgcaaggatgacacgcaaattcgtgaagcgttccatatttttgatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaaccttt

SEQ ID NO: 277677 - DNA, 2564 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcaggtgcagggcaacggggtcggacggcgggtaccggggtgggtgggccgcggcaccttgttcggccagggactggggcgtccggcctgagcttcagagggcagcgacgcccggacagaccgggacctggagctggttctgctcctaacgtccgagcccgccggccaggggcctcgggacccggccaagtcccacccccgctcgagaaaaggaagtttctttgcagttgtgacttggcacctgcagtcagggtgctgcgggtgaactggagtcccggaagcggggccgggcggaggagaggtaggaaggcgtgcttcagacactgccgctcttctcgtcgtttaacggcctcagatatcgggacacaacggtaaccgcaccgcgcgtgtcattccccctgcgtgcatttttcgagcggagtggcttacatttccacatacttatcagaagttactcactgacaaagtgatgttttcttcccatgttgagactatccgagtactaaagcataatgcttctgaagtggtgggttttaaaatttttaattttttttctgcccacttttgttgattgaaacattatagtattttgaagttacagtttttatattaatacctggattctactatgtaacataaccctttaagaattcgtggaggtaatcgccttggatgagagtaatttccttcattctcctgtcagcaaaattgcacttctagaggtctaagggaccttgtagattttgggaattgggaggcaagtttgattattcattttgaataagtacccacctcaactcttcagatcaaatgatctgaagggacatggtgtgggggggtagggaaatggaactgaggttaaaggagagccacttgctttaggggtgttacctcatttatcaggtcaccgtgattaattaggttctctgttcccctcagcccctggtgcattaagtgtttggtatattgtcatgaagtctaaaaggaaattctcagtttcaaggttataggtttcacgtgacccaattttagacattagttacatgtgcagtttttaaaatccatgtcagtaatatttcatttaggcaatggtaatgatttttaaagtaaattgaagggaaaatatattgagcccttattttgtggcagatgctatgaaagatgcaacatgtggcctgttcacagctacataattgtgacctgtgtggggaccaacttcgtgctctgtgacaccttctcaactcaccttttttactctttgaggccttacagctcttcacagtacaaggatgccaagggactccataaatgaactgataggctgggttctccagagcccattagctgagacttaccacctggaaagccaccaggctatttaaaaccccactagtcagaaaagagaggtggccttgtaatgaagcctcacttctgctttaaatctagtgaaacccaaaatgctgaggtttagtatgaggggggaacctttgcatgcaaataatgacatttagcatcataatcttcattatgaatgtttactaatggctcgttgctgattttcgtttttgagacggagtttgctcttgttgatgaggctggagtgcagtggcgcgatcttgactcactgcaacctccgcctcacagcttcaagattctgaaagatgaggggtgtgacaatgagcgcaaaggatagtggacacactggaataatgctgagaaattaagagtttaagaaagtctttgtgcgttgcttttccaaggataggaaagaggatatgatgggtttgaagtctaatgtccctacagccctctaagtctttgagggctttagggtcaggcctttggtatcagtctatacacaaaaccacggtcagtttactcaacatacttaataagaaaaagaatttgaggaactggatgtgactgtcattgctggagcctgtttgcagtatacttttactgagaaaaatagattaatgtgaggtccagagatgatataaaaataaaattgctcactgggcacggtggctcacacctgtaaccccagcactgtgggaggccaaggtgggcggattgcttgagcttaggagtttgagaccagcctgggcaacatggctaaaccccgtctctacaaaaaaattaaaaaattagccaagcatggtggcagacacctgtagtcccagctacttggagggcagaggtgggaggatggcttgagcccataatcatgccactgcattctagctttgatggcgaagtgagacctttctc

SEQ ID NO: 277678 - DNA, 1238 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttgtcccccaagtggggcccaccaagtctaagaaatccttctgcccagatataccgaactggtcccgagggaacctcggggccgcacccacgatccgataatcccgaatcggccacggcgagggggcccgtaatgcgccagatgacccctgaccccgcagaactcccagggagagcagcctgacgcagtctactgaagcaaatactacagcttagcgggcgaccaaacaacgaagccacactgacacagaggcagcacacagcccaaccaccgagccgtgagccacgataccgaccgccgccacccacgagaagcggcgagctccacacc

SEQ ID NO: 277679 - DNA, 452 bp, Homo sapiens
cagcctatataaaatacatttcaaaatgatctgtgctctttaaattaccaaaagcaaaatgttaattttttttttccctctaacagataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaaccttt

SEQ ID NO: 277680 - DNA, 436 bp, Homo sapiens
gggaaaagttagtttttaaataaccacttgtacatactaccctgtgacagtaatattcttcactaagtttgttttctatactatttcattttttctgacagttcctttctccccatccctactccttataggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcggtaagcatttgcctggagaattaatcacgaaatatatatttaccactctgaagactaattgtacttatttgagatgtagctctttttcgtacctaagagttattaatactatttcagtaaaaaaaaa

SEQ ID NO: 277681 - DNA, 2656 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaacctttcttccatatgtgactataatttggagtaaagtcttgttgactcaatatgggattttaatctaaaactgtaagtatggttttaaaagttaaataatgatattcatgattaaatgctattcatgattatgataaaatcttgggcttatgatagtaatttgacattttctgatcagccattcatttcttcagaagtggttaaattagagtctcctaatatttttaattaatgtgaaagtacagtagctcataaattatataatgcatgaaaatttatatgattataaatattcaggcatttaagaaataaaatgaagtattttgccttaaaaaattta

SEQ ID NO: 277682 - DNA, 1830 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaaccttt

SEQ ID NO: 277683 - DNA, 2082 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcggtaagcatttgcctggagaattaatcacgaaatatatatttaccactctgaagactaattgtacttatttgagatgtagctctttttcgtacctaagagttattaatactatttcagtaaaaaaaaa

SEQ ID NO: 277684 - DNA, 1137 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacaggaaagaccttttttatccctgtgaaatgagagtttct

SEQ ID NO: 277685 - DNA, 2510 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcaggtgcagggcaacggggtcggacggcgggtaccggggtgggtgggccgcggcaccttgttcggccagggactggggcgtccggcctgagcttcagagggcagcgacgcccggacagaccgggacctggagctggttctgctcctaacgtccgagcccgccggccaggggcctcgggacccggccaagtcccacccccgctcgaggtgaactggagtcccggaagcggggccgggcggaggagaggtaggaaggcgtgcttcagacactgccgctcttctcgtcgtttaacggcctcagatatcgggacacaacggtaaccgcaccgcgcgtgtcattccccctgcgtgcatttttcgagcggagtggcttacatttccacatacttatcagaagttactcactgacaaagtgatgttttcttcccatgttgagactatccgagtactaaagcataatgcttctgaagtggtgggttttaaaatttttaattttttttctgcccacttttgttgattgaaacattatagtattttgaagttacagtttttatattaatacctggattctactatgtaacataaccctttaagaattcgtggaggtaatcgccttggatgagagtaatttccttcattctcctgtcagcaaaattgcacttctagaggtctaagggaccttgtagattttgggaattgggaggcaagtttgattattcattttgaataagtacccacctcaactcttcagatcaaatgatctgaagggacatggtgtgggggggtagggaaatggaactgaggttaaaggagagccacttgctttaggggtgttacctcatttatcaggtcaccgtgattaattaggttctctgttcccctcagcccctggtgcattaagtgtttggtatattgtcatgaagtctaaaaggaaattctcagtttcaaggttataggtttcacgtgacccaattttagacattagttacatgtgcagtttttaaaatccatgtcagtaatatttcatttaggcaatggtaatgatttttaaagtaaattgaagggaaaatatattgagcccttattttgtggcagatgctatgaaagatgcaacatgtggcctgttcacagctacataattgtgacctgtgtggggaccaacttcgtgctctgtgacaccttctcaactcaccttttttactctttgaggccttacagctcttcacagtacaaggatgccaagggactccataaatgaactgataggctgggttctccagagcccattagctgagacttaccacctggaaagccaccaggctatttaaaaccccactagtcagaaaagagaggtggccttgtaatgaagcctcacttctgctttaaatctagtgaaacccaaaatgctgaggtttagtatgaggggggaacctttgcatgcaaataatgacatttagcatcataatcttcattatgaatgtttactaatggctcgttgctgattttcgtttttgagacggagtttgctcttgttgatgaggctggagtgcagtggcgcgatcttgactcactgcaacctccgcctcacagcttcaagattctgaaagatgaggggtgtgacaatgagcgcaaaggatagtggacacactggaataatgctgagaaattaagagtttaagaaagtctttgtgcgttgcttttccaaggataggaaagaggatatgatgggtttgaagtctaatgtccctacagccctctaagtctttgagggctttagggtcaggcctttggtatcagtctatacacaaaaccacggtcagtttactcaacatacttaataagaaaaagaatttgaggaactggatgtgactgtcattgctggagcctgtttgcagtatacttttactgagaaaaatagattaatgtgaggtccagagatgatataaaaataaaattgctcactgggcacggtggctcacacctgtaaccccagcactgtgggaggccaaggtgggcggattgcttgagcttaggagtttgagaccagcctgggcaacatggctaaaccccgtctctacaaaaaaattaaaaaattagccaagcatggtggcagacacctgtagtcccagctacttggagggcagaggtgggaggatggcttgagcccataatcatgccactgcattctagctttgatggcgaagtgagacctttctc

SEQ ID NO: 277686 - DNA, 379 bp, Homo sapiens
tcaattttgaaggattctcttaccactctgcttagtaatttctcttttttcttttttacatctttcataatgttgaaaaactaattctgctttctttttaagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtaacttaatgcataaaaccatttaaaacttttgtcattgtttaaacaaatatagattggcttcatttttcagttgtgtaaaatatgaaaa

SEQ ID NO: 277687 - DNA, 786 bp, Homo sapiens
agaattaaatgaaaccttccattaatagttagtgttctcttaaaatcaaatataaagcatgtattgaccagagattctattagacttcctgctggttctgggccttaaagtccagagagagagactgtagtttcaaaagtggcattaactccttcatgatagtaaactcaggatgatattttttatgctgctctttaatatgtctaccttcttaagagttacagcgcacattaagcctaaaactgaccacgttaaaggagattggaaaaacatttttaaggatttcaaagagacagaaattaatacaggtattctaaaatcctgtgtgccacaaaatgcacttattaactgaaattcagaatattatgcattactttatgattcttaggagtttgtgtatagttattgaaagtcattctgatttcattgtcttttttccattgctctcttttctcttacttgagtagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagagcataaaagaaaaaaacttttttccaaaagtaaaatatatttttttcttttatgacagcttcatgaatgtataattaacatacaataacctgcatatatttaaattgtacagtttgataagttttatttgtatacactgaaatcatcactgcaaatcagtattcattg

SEQ ID NO: 277688 - DNA, 2267 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagagttacagcgcacattaagcctaaaactgaccacgttaaaggagattggaaaaacatttttaaggatttcaaagagacagaaattaatacaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaaccttt

SEQ ID NO: 277689 - DNA, 2267 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaaccttt

SEQ ID NO: 277690 - DNA, 2143 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaaccttt

SEQ ID NO: 277691 - DNA, 2478 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaacctttcttccatatgtgactataatttggagtaaagtcttgttgactcaatatgggattttaatctaaaactgtaagtatggttttaaaagttaaataatgatattcatgattaaatgctattcatgattatgataaaatcttgggcttatgatagtaatttgacattttctgatcagccattcatttcttcagaagtggttaaattagagtctcctaatatttttaattaatgtgaaagtacagtagctcataaattatataatgcatgaaaatttatatgattataaatattcaggcatttaagaaataaaatgaagtattttgccttaaaaaattta

SEQ ID NO: 277692 - DNA, 1152 bp, Homo sapiens
cccctgccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaaccttt

SEQ ID NO: 277693 - DNA, 687 bp, Homo sapiens
gcagttcaagctggcagcctttgctgatgacggtcaggaggccaactgcgcctggggagcagcgggatccggggatggggctgccctgtgtgctcacctgcctgacctgccccaggcctcctcctgtccccaccctgcctaatgctctagagtccccctgggctggcctcaggattgcaagcagtgcgagggcctggtctcggccctggtctcagccctatccagatgtccgaggcagatggaccacccgctgagcgtcagaaatgggctcctcatcagcatctctgcccatccatccgtcagtctgtctacctgccccctaggagccaggccctgccccacggtggtgaaggagagtgactccgtgctgcccctgcaagccccggtcacaggggacggcagggaacaggtcgctgcctggtcgtgccaagagcttccctggaggagcggaggctagggcaagagcctcacccccttcctctcccttcctccttccttcccctcctctccgtgtgccctgcaggtatccctctggcctccccggctcacccctgctcccttccctgctgggggccagccaaggcctcacctggctgcagggccaagcctgccatcaacagggcaagcagcacagccttcgtggtcactggtgggctgtggtggagagggcctcaggtgactttatat

SEQ ID NO: 277694 - DNA, 818 bp, Homo sapiens
gagaggctggactgcccacagtcaacaccagcgggtttcctggagccagtgagggccccggggctgggcaggtccgagtctcctccctgagcgacctgcacctccctctccctttgtccttctttccacctctggaggacagagcctacccagggccatatctcagccaccccgggctgagggctgaaacgtcctcaagacccagattatgcctctcccacctcccccacctcacagtgcaaggccagacaagggagaccctttctccagactcctccaggcctcggccttccagccaaggatgagggcacctccctgggccctgtgctcctatagaagctgtgccgccctctggggcccacggcccgcagggtgatgagccttggtcacagcgtcactgacagatcattagcaggtgctgcaaaggacaggggcaggggctgttccggtataaaccaaaagtaacattctaaggccccccagccatctgagtggaaccctcctcttggcaagggctttccgaagttaacctgaaaaactggttcaggccatgacagcaaagggttggatagcctcattatccctcctcccttcagaactctggaacagccagcgttaacatcaacacaggccttcagtctgatgagaaacatttaccatctattgtctcggaagcctgctacctggaggcttcatctgatgataaagccttggtctcccacaaccccgtataacccagacattcctttctattggataactcttgcaagcgattgccaaccagaagatgtttaaatccacctataacctggaagccc

SEQ ID NO: 277695 - DNA, 582 bp, Homo sapiens
gcagttcaagctggcagcctttgctgatgacggtcaggaggccaactgcgcctggggagcagcgggatccggggatggggctgccctgtgtgctcacctgcctgacctgccccaggcctcctcctgtccccaccctgcctaatgctctagagtccccctgggctggcctcaggattgcaagcagtgcgagggcctggtctcggccctggtctcagccctatccagatgtccgaggcagatggaccacccgctgagcgtcagaaatgggttgcctccagggactccagattttcctgtttgctcttggccttctgcccacccaccccactgccatgggcccaaagcagccgggttccctggagatcctgtcttccacctagtgcagggcatgaggccggggccaggacagccggaccaggccctggggcttctgggagctgactcaccttgcagggagtcccaccaccaccttctggggccccacacggtcccatgctggaacacacatccctgtgtgtaattttttttatttcatgcagcattaattaaaaaaataaagatagcatgtcacttgcaaagcca

SEQ ID NO: 277696 - DNA, 490 bp, Homo sapiens
gcagttcaagctggcagcctttgctgatgacggtcaggaggccaactgcgcctggggagcagcgggatccggggatggggctgccctgtgtgctcacctgcctgacctgccccaggcctcctcctgtccccaccctgcctaatgctctagagtccccctgggctggcctcaggattgcaagcagtgcgagggcctggtctcggccctggtctcagccctatccagatgtccgaggcagatggaccacccgctgagcgtcagaaatgggaactctggaacagccagcgttaacatcaacacaggccttcagtctgatgagaaacatttaccatctattgtctcggaagcctgctacctggaggcttcatctgatgataaagccttggtctcccacaaccccgtataacccagacattcctttctattggataactcttgcaagcgattgccaaccagaagatgtttaaatccacctataacctggaagccc
